US011345896B2

(12) United States Patent
Evans et al.

(10) Patent No.: US 11,345,896 B2
(45) Date of Patent: May 31, 2022

(54) SYNTHETIC CHIMERIC POXVIRUSES

(71) Applicants: David Evans, Edmonton (CA); Ryan Noyce, Edmonton (CA); Seth Lederman, New York, NY (US)

(72) Inventors: David Evans, Edmonton (CA); Ryan Noyce, Edmonton (CA); Seth Lederman, New York, NY (US)

( * ) Notice: Subject to any disclaimer, the term of this patent is extended or adjusted under 35 U.S.C. 154(b) by 0 days.

(21) Appl. No.: 15/802,189

(22) Filed: Nov. 2, 2017

(65) Prior Publication Data
US 2018/0251736 A1 Sep. 6, 2018

Related U.S. Application Data

(60) Provisional application No. 62/434,794, filed on Dec. 15, 2016, provisional application No. 62/416,577, filed on Nov. 2, 2016.

(51) Int. Cl.
| | |
|---|---|
| *C12N 7/00* | (2006.01) |
| *A61K 39/275* | (2006.01) |
| *A61K 39/12* | (2006.01) |
| *A61P 31/20* | (2006.01) |
| *A61K 39/00* | (2006.01) |

(52) U.S. Cl.
CPC ............... *C12N 7/00* (2013.01); *A61K 39/12* (2013.01); *A61K 39/275* (2013.01); *A61P 31/20* (2018.01); *A61K 2039/5254* (2013.01); *C12N 2710/24021* (2013.01); *C12N 2710/24034* (2013.01); *C12N 2710/24121* (2013.01); *C12N 2710/24134* (2013.01)

(58) Field of Classification Search
None
See application file for complete search history.

(56) References Cited

U.S. PATENT DOCUMENTS

| | | | |
|---|---|---|---|
| 2,787,577 A | 4/1957 | Allisbaugh | |
| 4,683,195 A | 7/1987 | Mullis | |
| 4,683,202 A | 7/1987 | Mullis | |
| 4,754,065 A | 6/1988 | Levenson | |
| 4,800,159 A | 1/1989 | Mullis | |
| 6,723,325 B1 | 4/2004 | Weltzin | |
| 2004/0014034 A1 | 1/2004 | Evans | |

(Continued)

FOREIGN PATENT DOCUMENTS

| | | |
|---|---|---|
| EP | 3045181 | 7/2016 |
| WO | 2005028634 | 3/2005 |

(Continued)

OTHER PUBLICATIONS

Attwood, T. The Babel of Bioinformatics, Science (2000) vol. 290, No. 5491, pp. 471-473 (Year: 2000).*

(Continued)

*Primary Examiner* — Michelle S Horning
(74) *Attorney, Agent, or Firm* — Haley Guiliano LLP; James F. Haley, Jr.; Stacey W. Chung

(57) ABSTRACT

The invention relates, in general, to synthetic chimeric poxviruses, compositions comprising such viruses, and the development and use of systems and methods for producing such synthetic chimeric poxviruses. The synthetic chimeric poxviruses are well suited for live virus vaccines and pharmaceutical formulations.

20 Claims, 21 Drawing Sheets
(10 of 21 Drawing Sheet(s) Filed in Color)
Specification includes a Sequence Listing.

(56) References Cited

U.S. PATENT DOCUMENTS

| | | |
|---|---|---|
| 2018/0251736 A1 | 9/2018 | Evans |
| 2021/0236619 A1 | 8/2021 | Lederman |

FOREIGN PATENT DOCUMENTS

| | | |
|---|---|---|
| WO | 2007093133 | 8/2007 |
| WO | WO2013038066 | 3/2013 |
| WO | WO2014160475 | 10/2014 |
| WO | WO2017027757 | 2/2017 |
| WO | WO2018057755 | 3/2018 |
| WO | WO2018085582 | 5/2018 |
| WO | WO2019043282 | 3/2019 |
| WO | WO2019213452 | 11/2019 |

OTHER PUBLICATIONS

Baker et al., Protein Structure Predication and Structural Genomics, Science (2001) vol. 294, No. 5540, pp. 93-96 (Year: 2001).*
Aragon et al., "Risks of serious complications and death from smallpox vaccination: a systematic review of the United States experience, 1963-1968," BMC Public Health 3:26 1-12 (2003).
Aragon et al., "The risks and benefits of pre-event smallpox vaccination: where you stand depends on where you sit," Annals of Emergency Medicine, 42(5):681-684 (2003).
Artenstein et al., "A novel, cell culture-derived smallpox vaccine in vaccinia-naive adults," Vaccine, 23: 3301-3309 (2005).
Child et al., "Insertional inactivation of the large subunit of ribonucleotide reductase encoded by vaccinia virus is associated with reduced virulence in vivo," Virology, 174:625-629 (1990).
Damaso, "Revisiting Jenner's mysteries, the role of the Beaugency lymph in the evolutionary path of ancient smallpox vaccines," Lancet, S1473-3099(17)30445 (2017) (9 pages).
DiEuliis, et al., "A Holistic Assessment of the Risks and Benefits of the Synthesis of Horsepox Virus," mSphere, 3:(2)e00074-18 (2018)(8 pages).
Frey et al. "Comparison of the safety and immunogenicity of ACAM1000, ACAM2000 and Dryvax in healthy vaccinia-naive adults," Vaccine 27:1637-1644 (2008).
Frey et al., "Clinical responses to undiluted and diluted smallpox vaccine," New England Journal of Medicine, 346:1265-1274 (2002).
Garcel et al. "Phenotypic and genetic diversity of the traditional Lister smallpox vaccine," Vaccine, 27:708-17 (2009).
Greenberg et al., "ACAM2000: a newly licensed cell culture-based live vaccinia smallpox vaccine," Expert Opinion on Investigational Drugs, 17:555-564 (2008).
Imperiale, "Re-creation of Horsepox Virus," mSphere, 3(2)e00079-18 (2018)(1 page).
Kennedy et al., "T-Cell epitope discovery for variola and vaccinia viruses," Reviews in Medical Virology, 17: 93-113 (2007).
Koblentz, "A Critical Analysis of the Scientific and Commercial Rationales for the De Novo Synthesis of Horsepox Virux," mSphere, 3(2)e00040-18 (2018)(10 pages).
Koblentz, "The De Novo Synthesis of Horsepox Virus: Implications for Biosecurity and Recommendations for Preventing the Reemergence of Smallpox," Health Security, 15(5):620-628 (2017).
Kupferschmidt, "A paper showing how to make a smallpox cousin just got published. Critics wonder why," downloaded from http://www.sciencemag.org/news/2018/01/paper-showing-how-make-smallpox-cousin-just-got-published-critics-wonder-why on Mar. 12, 2018 (Jan. 19, 2018) (10 pages).
Kupferschmidt, "How Canadian researchers reconstituted an extinct poxvirus for $100,000 using mail-order DNA," Science Magazine (2017) (5 pages).
Li et al., Genomic sequence and analysis of a vaccinia virus isolate from a patient with a smallpox vaccine-related complication, Virology Journal, 3:88; 9 pages (2006).
Li et al., "Recovery of a chemically synthesized Japanese encephalitis virus reveals two critical adaptive mutations in NS2B and NS4A," Journal of General Virology, 94(Pt. 4):806-815 (2014).
Li et al., "On the origin of smallpox: correlating variola phylogenies with historical smallpox records," PNAS, 104:15787-15792 (2007).
Mack et al., "A prospective study of serum antibody and protection against smallpox,"The American Journal of Tropical Medicine and Hygiene, 21: 214-218 (1972).
Marriott et al., "Clonal vaccinia virus grown in cell culture fully protects monkeys from lethal monkeypox challenge," Vaccine, 26: 581-588 (2008).
Medaglia, et al., "Genomic analysis, phenotype, and virulence of the historical Brazilian smallpox vaccine strain IOC: Implications for the origins and evolutionary relationships of vaccinia virus," Journal of Virology, 89:11909-11925 (2015).
Merkel et al., "Development of a highly efficacious vaccinia-based dual vaccine against smallpox and anthrax, two important bioterror entities," PNAS, 107:18091-18096(2010).
Monath et al., "ACAM2000 clonal Vero cell culture vaccinia virus (New York City Board of Health strain)—a second-generation smallpox vaccine for biological defense," International Journal of Infectious Diseases, 8(Supp 2)S31-S44 (2004).
Morikawa et al., "An attenuated LC16m8 smallpox vaccine: analysis of full-genome sequence and induction of immune protection," Journal of Virology, 79:11873-11891 (2005).
Nalca et al., "ACAM2000: the new smallpox vaccine for United States Strategic National Stockpile," Drug Design, Development Therapy, 4:71-79 (2010).
Noyce et al., "Construction of an infectious horsepox virus vaccine from chemically synthesized DNA Fragments," PLOS One, 13(1):e0188453 (2018) (16 pages).
Oldfield et al., "Genome-wide engineering of an infectious clone of herpes simplex virus type 1 using synthetic genomics assembly methods," PNAS, 114(42):e8885-e8894 (2017).
Osborne et al., "Genomic differences of Vaccinia virus clones from Dryvax smallpox vaccine: the Dryvax-like ACAM2000 and the mouse neurovirulent Clone-3," Vaccine, 25:8807-8832 (2007).
Qin et al., "Genomic analysis of the vaccinia virus strain variants found in Dryvax vaccine," Journal of Virology, 85(24):13049-013060 (2011).
Sarkar et al., "The minimum protective level of antibodies in smallpox," Bull World Health Organ, 52:307-311 (1975).
Schrick et al., An Early American Smallpox Vaccine Based on Horsepox, New England Journal of Medicine, 377(15):1491-1492 (2017).
Tonix Pharmaceuticals Press Release "Tonix Pharmaceuticals Announces Publication Reporting Synthesis, Construction and Characterization of a Potential Smallpox-Preventing Vaccine Candidate TNX-801 (Live Horsepox Virus from Cell Culture)," Jan. 19, 2018 (4 pages).
Tulman et al., "Genome of horsepox virus," Journal of Virology, 80(18):9244-9258 (2006).
Walsh et al., "Vaccinia viruses: vaccines against smallpox and vectors against infectious diseases and tumors," Expert Review of Vaccines, 10:1221-1240 (2011).
Weltzin et al., "Clonal vaccinia virus grown in cell culture as a new smallpox vaccine," Nature Medicine, 9(9):1125-1130 (2003).
WHO Advisory Committee on Variola Virus Research: Report of the Eighteenth Meeting, Nov. 2-3, 2016, Geneva, Switzerland, World Health Organisation, ww.who.int/csr/resources/publications/smallpox/variola-research-november-2016, Chapter 18, pp. 29-31 (downloaded Jan. 30, 2017) (58 pages).
Yao et al., "Construction of recombinant vaccinia viruses using leporipoxvirus-catalyzed recombination and reactivation of orthopoxvirus DNA," Methods in Molecular Biology, 269:51-64 (2004).
Yao et al., "High-frequency genetic recombination and reactivation of orthopoxviruses from DNA fragments transfected into leporipoxvirus-infected cells," Journal of Virology, 77(13):7281-7290 (2003).
GenBank Accession No. AY313847.1, "Vaccinia virus strain Acambis clone 2000, complete genome" (2010) (82 pages).
Jefferson, et al., "The mechanisms of genetically modified vaccinia viruses for the treatment of cancer," Critical Reviews in Oncology/Hematology, 95(3):407-416 (2015).
Kupferschmidt, "A paper showing how to make a smallpox cousin just got published. Critics wonder why," Science, URL: https://

(56) References Cited

OTHER PUBLICATIONS www.sciencemag.org/news/2018/01/paper-showing-how-make-smallpox-cousin-just-got-published-critics-wonder-why> (2018) (11 pages).
Kushner, "Synthetic Biology Could Bring a Pox on US All," Science, (18 pages) (2019).
Loy, "An Account of Some Experiments on the Origin of the Cow-Pox," Webster (1801) (29 Pages).
Noyce, et al., "Synthetic horsepox viruses and the continuing debate about dual use research," PLoS Pathogens, 14(10):e1007025 (2018).
U.S. Appl. No. 14/207,727, filed Mar. 13, 2014, Pending.
U.S. Appl. No. 17/050,946, filed Oct. 27, 2020, Pending.
U.S. Appl. No. 17/049,741, filed Oct. 22, 2020, Pending.
U.S. Appl. No. 17/187,678, filed Feb. 26, 2021, Pending.
Du et al., "Vaccinia virus DNA replication: two hundred base pairs of telomeric sequence confer optimal replication efficiency on minichromosome templates," PNAS, 93(1):9693-9698 (1996).
Chakrabarti et al., "Compact, synthetic, vaccinia virus early/late promoter for protein expression," BioTechniques, 23(6):1094-1097 (1997).
Di Pilato et al., "Modification of promoter spacer length in vaccinia virus as a strategy to control the antigen expression," Journal of General Virology, 96(8):2360-2371 (2015).
Earl et al., "Removal of cryptic poxvirus transcription termination signals from the human immunodeficiency virus type 1 envelope gene enhances expression and immunogenicity of a recombinant vaccinia virus," Journal of Virology, 64(5):2448-2451 (1990).
Esparza et al., "Investigations on the historical origin and evolution of the smallpox vaccine," Gac Med Caracas, 128(Supl 1):S88-S97 (2020).
Falkner et al., "*Escherichia coli* gpt gene provides dominant selection for vaccinia virus open reading frame expression vectors," Journal of Virology, 62(6):1849-54 (1988).
Gammon et al., "Vaccinia Virus-Encoded Ribonucleotide Reductase Subunits Are Differentially Required for Replication and Pathogenesis," Plos Pathogens, 6(7):e1000984, pp. 1-20, 2010.
Hartman et al., "SARS-CoV-2 infection of African green monkeys results in mild respiratory disease discernible by PET/CT imaging and shedding of infectious virus from both respiratory and gastrointestinal tracts," PLOS Pathogens, 16(9):e1008903 (2020).
Himly et al., "The DF-1 chicken fibroblast cell line: transformation induced by diverse oncogenes and cell death resulting from infection by avian leukosis viruses," Virology, 248(2):295-304 (1998).
Jenner, "An Inquiry into the Causes and Effects of the Variolae Vaccinae, a Disease Discovered in Some of the Western Counties of England, Particularly Gloucestershire, and Known by the Name of the Cow Pox," Springfield, e-Printed for Dr. Samuel Cooley, by Ashley & Brewer, 1802 (1800) (134 pages) (6 parts).
Kolb et al., "Improvements in the rabbit scarification method for the assay of smallpox vaccine," Bulletin of the World Health Organization, 25(1):19-24 (1961).
Korber et al., "Spike mutation pipeline reveals the emergence of a more transmissible form of SARS-CoV-2," bioRxiv 2020.04.29. 069054 (2020) (33 pages).
Kremer et al., "Vaccinia virus and poxvirology, Methods and Protocols," Second Edition, vol. 890, Humana Press, Totowa, NJ, pp. 59-92 (2012) (339 pages).
Leon et al., "The EB66® cell line as a valuable cell substrate for MVA-based vaccines production," Vaccine, 34(48):5878-5885 (2016).
Lohr et al., "New avian suspension cell lines provide production of influenza virus and MVA in serum-free media: studies on growth, metabolism and virus propagation," Vaccine, 27(36):4975-4982 (2009).
Pallesen et al., "Immunogenicity and structures of a rationally designed prefusion MERS-CoV spike antigen," PNAS, 114(35):E7348-E7357 (2017).
Ralph et al., "2019-nCoV (Wuhan virus), a novel Coronavirus: human-to-human transmission, travel-related cases, and vaccine readiness," Journal of Infection in Developing Countries, 31:14(1):3-17 (2020).

Rice et al., "An efficient method for generating poxvirus recombinants in the absence of selection," Viruses, 3(3): 217-232 (2011).
Roberts et al., "A mouse-adapted SARS-coronavirus causes disease and mortality in BALB/c mice," PLoS Pathogens, 3(1):e5.doi:10.1371 (2007).
Sadoff et al., "Interim Results of a Phase 1-2a Trial of Ad26. COV2.S Covid-19 VaccineInterim Results of a Phase 1-2a Trial of Ad26.COV2.S Covid-19 Vaccine," New England Journal of Medicine, 384(19):1824-1835 (2021).
Subbarao et al., "Prior infection and passive transfer of neutralizing antibody prevent replication of severe acute respiratory syndrome coronavirus in the respiratory tract of mice," Journal of Virology, 78(7):3572-3577 (2004).
Yager et al., "Pathology of Domestic Animals," The skin and appendages, K. V. F. Jubb, P.C. Kennedy, N. Palmer, 4th Edition, vol. 1., Academic Press, San Diego, CA, pp. 531-738 (1993) (787 pages) (4 parts).
Baroudy et al., "Incompletely base-paired flip-flop terminal loops link the two DNA strands of the vaccinia virus genome into one uninterrupted polynucleotide chain," Cell, 28(2):315-24 (1982).
Brickmann et al., "Re-assembly of nineteenth-century smallpox vaccine genomes reveals the contemporaneous use of horsepox and horsepox-related viruses in the USA," Genome Biology, 21:286 (2020) (6 pages).
Coukos et al., "Use of carrier cells to deliver a replication-selective herpes simplex virus-1 mutant for the intraperitoneal therapy of epithelial ovarian cancer," Clinical Cancer Research, 5(6):1523-37 (1999).
FDA Briefing Document, "Vaccines and Related Biological Products Advisory Committee Meeting," Sep. 19, 2012 (30 pages).
Garcia-Castro et al., "Treatment of metastatic neuroblastoma with systemic oncolytic virotherapy delivered by autologous mesenchymal stem cells: an exploratory study," Cancer Gene Therapy, 17(7): 476-83 (2010).
Murphy et al., "Adventitious Agents and Smallpox Vaccine in Strategic National Stockpile," Emerging Infectious Diseases, 11(7):1086-1089 (2005).
Paez et al., "Stability of vaccinia virus DNA during persistent infections: accumulation of left-end deletions and of tandem repeats at both ends of the viral genome and prevention by interferon," Virology, 163(1):145-154 (1988).
Park et al., "Phase 1b Trial of Biweekly Intravenous Pexa-Vec (JX-594), an Oncolytic and Immunotherapeutic Vaccinia Virus in Colorectal Cancer," Molecular Therapy, 23(9):1532-2540 (2015).
Qin et al., "Evolution of and evolutionary relationships between extant vaccinia virus strains," Journal of Virology, 89(3):1809-1824 (2015).
Sam et al., "Expression of poxvirus DNA in coinfected cells and marker rescue of thermosensitive mutants by subgenomic fragments of DNA," Annales de lInstitut Paseur/Virologie, 132(2): 135-150 (1981).
Scheiflinger et al., "Construction of chimeric vaccinia viruses by molecular cloning and packaging," PNAS, 89(21):9977-81 (1992).
Shvalov et al., "Complete Genome Sequence of Vaccinia Virus Strain L-IVP," Genome Announcements, 4(3):e00372-16 (2016).
Tcherepanov et al, "Genome Annotation Transfer Utility (GATU): rapid annotation of viral genomes using a closely related reference genome," BMC Genomics, 7:150 (2006) (10 pages).
Vivalis, From cells to therapeutics, Forget eggs and accelerate your vaccine development with the EBx® cell line (4 pages) (undated).
Zhang et al., "Eradication of Solid Human Breast Tumors in Nude Mice with an Intravenously Injected Light-Emitting Oncolytic Vaccinia Virus," Cancer Research, 67(20):10038-46 (2007).
Baxby, "The origins of vaccinia virus," Journal of Infectious Disease, 136(3):453-455 (1977).
Buller et al., "Decreased virulence of recombinant vaccinia virus expression vectors is associated with a thymidine kinase-negative phenotype," Nature, 317:813-815 (1985).
Czub et al., "Evaluation of modified vaccinia virus Ankara based recombinant SARS vaccine in ferrets," Vaccine, 23(17-18):2273-2279 (2005).

(56) References Cited

OTHER PUBLICATIONS

Gomez et al., "The Poxvirus Vectors MVA and NYVAC as Gene Delivery Systems for Vaccination Against Infectious Diseases and Cancer," Current Gene Therapy, 8(2):97-120 (2008).
Hendrickson et al., "Orthopoxvirus genome evolution: the role of gene loss," Viruses, 2:1933-1967 (2010).

* cited by examiner

A Modified scHPXV genome scHPXV YFP-gpt::095 genome
213, 305 bp

B Nucleotide sequence of VACV (WR strain) terminal hairpin loops with concatamer resolution sites S Form F Form

C Secondary structure of VACV (WR) terminal loops

PFGE of scHPXV YFP-gpt::095 following BsaI and HindIII digest

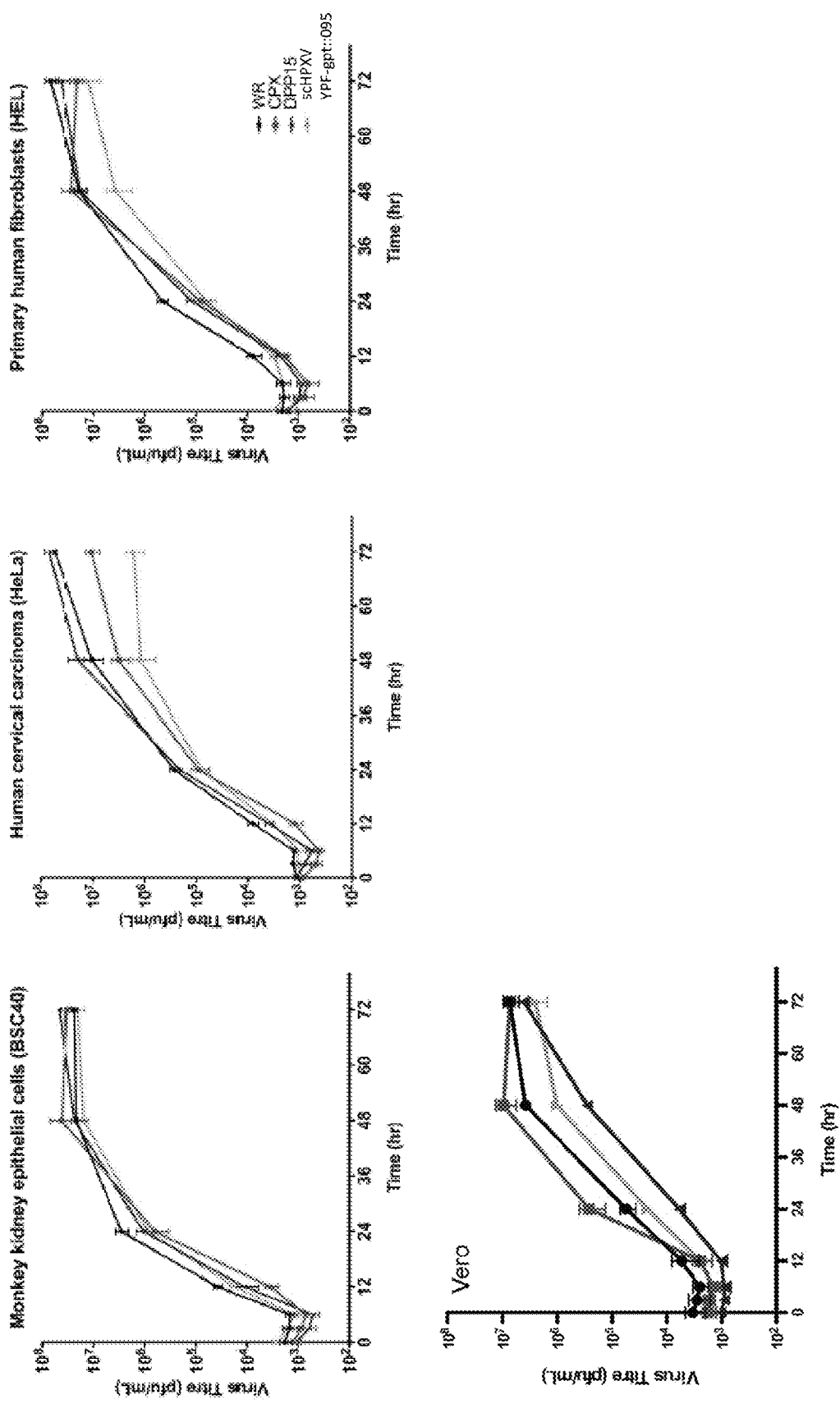

FIG. 5B

Plaque size of scHPXV YFP-gpt::095 in BSC-40 cells

FIG. 5C

Plaque morphology of scHPXV YFP-gpt::095 in BSC-40 cells scHPXV YFP-gpt::095 | CPXV | DPP15 | VACV-WR

SYNTHETIC CHIMERIC POXVIRUSES

RELATED APPLICATIONS

A Sequence Listing associated with this application is being submitted electronically via EFS-Web in text format, and is hereby incorporated by reference in its entirety into the specification. The name of the text file containing the Sequence Listing is 104545-0026-101-SL.txt. The text file, created on May 25, 2018, is 863,281 bytes in size.

This application claims priority and benefit from U.S. Provisional Patent Applications 62/434,794, filed Dec. 15, 2016, and 62/416,577, filed Nov. 2, 2016. The contents and disclosures of each of these prior provisional applications are incorporated herein by reference in their entirety.

BACKGROUND OF THE INVENTION

Poxviruses (members of the Poxviridae family) are double-stranded DNA viruses that can infect both humans and animals. Poxviruses are divided into two subfamilies based on host range. The Chordopoxviridae subfamily, which infects vertebrate hosts, consists of eight genera, of which four genera (Orthopoxvirus, Parapoxvirus, Molluscipoxvirus, and Yatapoxvirus) are known to infect humans. Smallpox is caused by infection with variola virus (VARV), a member of the genus Orthopoxvirus (OPV). The OPV genus comprises a number of genetically related and morphologically identical viruses, including camelpox virus (CMLV), cowpox virus (CPXV), ectromelia virus (ECTV, "mousepox agent"), horsepox virus (HPXV), monkeypox virus (MPXV), rabbitpox virus (RPXV), raccoonpox virus, skunkpox virus, Taterapox virus, Uasin Gishu disease virus, vaccinia virus (VACV), variola virus (VARV) and volepox virus (VPV). Other than VARV, at least three other OPVs, including VACV, MPXV and CPXV, are known to infect humans. So far, vaccination with "live" VACV is the only proven protection against smallpox. An aggressive program of vaccination led to the eradication of smallpox in 1980 and routine smallpox vaccination of the public was stopped. However, a need remains to find new safe and effective means of vaccinating individuals against VARV and other OPVs.

A variety of preparations of VACV have been used as smallpox vaccines. Most of these comprised of a number of related viruses (e.g., Dryvax), and one comprises a single molecular clone, ACAM2000. However, like Dryvax and other VACV vaccines, even ACAM2000 is associated with serious side effects including cardiomyopathy and pericarditis. To reduce risks, the ACAM2000 vaccine, like other live vaccines, has numerous contraindications that preclude individuals with cancer, immunodeficiencies, organ transplant recipients, patients with atopic dermatitis, eczema, psoriasis, heart conditions, and patients on immunosuppressants. It is estimated that 15-50% of the US population would fall under one of these categories, therefore confirming the need for the development of a safer vaccine or vaccination protocol (Kennedy et al., 2007 Kennedy R, Poland G A. 2007. T-Cell epitope discovery for variola and vaccinia viruses. Rev Med Virol17: 93-113). Therefore, there is a need for the development of a vaccine that is equivalent in efficacy to Dryvax or ACAM2000™, but that is safer.

The present invention provides chimeric poxviruses assembled and replicated from chemically synthesized DNA. Because chemical genome synthesis is not dependent on a natural template, a plethora of structural and functional modifications of the viral genome are possible. Chemical genome synthesis is particularly useful when a natural template is not available for genetic replication or modification by conventional molecular biology methods.

SUMMARY OF THE INVENTION

The present invention provides synthetic chimeric poxviruses (e.g., synthetic chimeric OPV or scOPV), methods for producing such viruses and the use of such viruses, for example, as immunogens, in immunogenic formulations, in in vitro assays, as vehicles for heterologous gene expression, or as oncolytic agents. The synthetic chimeric poxviruses of the invention are characterized by one or more modifications relative to a wildtype poxvirus.

In part, the present invention relates to the discovery that a synthetic chimeric poxvirus (e.g., scOPV) can be produced from chemically synthesized overlapping fragments of the poxviral genome. Accordingly, the present invention, in part, provides synthetic chimeric poxviruses (e.g., scOPV) replicated and assembled from chemically synthesized nucleic acids. The disclosure also provides compositions comprising such viruses. The disclosure further provides methods of using the poxviruses produced according to the methods of the disclosure.

In another aspect, the invention provides a method for protecting individual humans and populations of humans against the consequences of infection with smallpox, pseudotypes of smallpox virus and other OPVs using the synthetic chimeric poxviruses of the invention. In another aspect, the invention is a method for protecting individual humans and populations of humans against the consequences of infection with smallpox (VARV) and pseudotypes of smallpox virus by using the synthetic chimeric poxviruses of the invention, with less toxicity, morbidity and mortality than available VACV-based vaccines. In certain aspects, the invention provides a synthetic chimeric poxvirus (scPV) that is replicated and reactivated from DNA derived from synthetic DNA, the viral genome of said virus differing from a wild type genome of said virus in that it is characterized by one or more modifications, the modifications being derived from a group comprising chemically synthesized DNA, cDNA or genomic DNA.

In some embodiments, the synthetic DNA is selected from one or more of chemically synthesized DNA, PCR amplified DNA, engineered DNA and polynucleotides comprising nucleoside analogs. In some embodiments, the synthetic DNA is chemically synthesized DNA.

In some embodiments, the one or more modifications comprise one or more deletions, insertions, substitutions, or a combination thereof. In some embodiments, the one or more modifications comprise one or more modifications to introduce one or more unique restriction sites.

In some embodiments, the viral genome comprises heterologous terminal hairpin loops. In some embodiments, the viral genome comprises terminal hairpin loops derived from vaccinia virus. In some embodiments, the left and right terminal hairpin loops a) comprise the slow form and the fast form of the vaccinia virus terminal hairpin loop, respectively, b) comprise the fast form and the slow form of the vaccinia virus terminal hairpin loop, respectively, c) both comprise the slow form of the vaccinia virus terminal hairpin loop, or d) both comprise the fast form of the vaccinia virus terminal loop.

In some embodiments, the virus is replicated and reactivated from overlapping chemically synthesized DNA fragments that correspond to substantially all of the viral genome of the scPV.

In some embodiments, the virus is replicated and reactivated from 1-14 overlapping fragments. In some embodiments, the virus is replicated and reactivated from 8-12 overlapping fragments. In some embodiments, the virus is replicated and reactivated from 10 overlapping fragments.

In some embodiments, the virus is reactivated using leporipox virus-catalyzed recombination and reactivation. In some embodiments, the leporipox virus is selected from the group consisting of: Shope fibroma virus (SFV), hare fibroma virus, rabbit fibroma virus, squirrel fibroma virus, and myxoma virus.

In certain aspects, the invention provides a synthetic chimeric orthopox virus (scOPV) that is replicated and reactivated from DNA derived from synthetic DNA, the viral genome of said virus differing from a wild type genome of said virus in that it is characterized by one or more modifications, the modifications being derived from a group comprising chemically synthesized DNA, cDNA or genomic DNA.

In some embodiments, the synthetic DNA is selected from one or more of: chemically synthesized DNA, PCR amplified DNA, engineered DNA and polynucleotides comprising nucleoside analogs. In some embodiments, the synthetic DNA is chemically synthesized DNA.

In some embodiments, the OPV is selected from the group consisting of: camelpox (CMLV) virus, cowpox virus (CPXV), ectromelia virus (ECTV), horsepox virus (HPXV), monkeypox virus (MPXV), vaccinia virus (VACV), variola virus (VARV), rabbitpox virus (RPXV), raccoon poxvirus, skunkpox virus, Taterapox virus, Uasin Gishu disease virus, and volepox virus.

In some embodiments, the OPV is a VACV. In some embodiments, the viral genome is based on the genome of VACV strain ACAM2000 and differs from the ACAM2000 genome in that it is characterized by one or more modifications. In some embodiments, the viral genome is based on the genome of VACV strain IOC and differs from the IOC genome in that it is characterized by one or more modifications. In some embodiments, the viral genome is based on the genome of VACV strain MVA and differs from the MVA genome in that it is characterized by one or more modifications. In some embodiments, the viral genome is based on the genome of VACV strain MVA-BN and differs from the MVA-BN genome in that it is characterized by one or more modifications. In some embodiments, the wild type VACV genome is the genome of a strain selected from the group consisting of: Western Reserve, Clone 3, Tian Tian, Tian Tian clone TT9, Tian Tian clone TP3, NYCBH, Wyeth, Copenhagen, Lister 107, Lister-LO, IHD-W, LC16m18, Lederle, Tashkent clone TKT3, Tashkent clone TKT4, USSR, Evans, Praha, LIVP, Ikeda, EM-63, Malbran, Duke, 3737, CV-1, Connaught Laboratories, Serro 2, CM-01, Dryvax clone DPP13, Dryvax clone DPP15, Dryvax clone DPP20, Dryvax clone DPP17, Dryvax clone DPP21, and chorioallantois vaccinia virus Ankara.

In some embodiments, the one or more modifications comprise one or more deletions, insertions, substitutions, or a combination thereof.

In some embodiments, the one or more modifications comprise one or more modifications to introduce one or more unique restriction sites. In some embodiments, the one or more modifications comprise one or more modifications to eliminate one or more restriction sites. In some embodiments, the one or more modifications comprise one or more modifications to eliminate one or more AarI restriction sites. In some embodiments, the one or more modifications comprise one or more modifications to eliminate all AarI restriction sites. In some embodiments, the one or more modifications comprise one or more modifications to eliminate one more BsaI restriction sites.

In some embodiments, the viral genome comprises heterologous terminal hairpin loops. In some embodiments, the viral genome comprises terminal hairpin loops derived from vaccinia virus. In some embodiments, the left and right terminal hairpin loops a) comprise the slow form and the fast form of the vaccinia virus terminal hairpin loop, respectively, b) comprise the fast form and the slow form of the vaccinia virus terminal hairpin loop, respectively, c) both comprise the slow form of the vaccinia virus terminal hairpin loop, or d) both comprise the fast form of the vaccinia virus terminal loop. In some embodiments, the slow form comprises a nucleotide sequence that is at least 85% identical to the nucleotide sequence of SEQ ID NO: 11 and the fast form comprises a nucleotide sequence that is at least 85% identical to the nucleotide sequence of SEQ ID NO: 12. In some embodiments, the slow form comprises a nucleotide sequence that is at least 90% identical to the sequence of SEQ ID NO: 11 and the fast form comprises a nucleotide sequence that is at least 90% identical to the nucleotide sequence of SEQ ID NO: 12. In some embodiments, the slow form comprises a nucleotide sequence that is at least 95% identical to the nucleotide sequence of SEQ ID NO: 11 and the fast form comprises a nucleotide sequence that is at least 95% identical to the nucleotide sequence of SEQ ID NO: 12. In some embodiments, the slow form consists of the nucleotide sequence of SEQ ID NO: 11 and the fast form consists of the nucleotide sequence of SEQ ID NO: 12.

In some embodiments, the virus is replicated and reactivated from overlapping chemically synthesized DNA fragments that correspond to substantially all of the viral genome of the OPV.

In some embodiments, the virus is replicated and reactivated from 1-14 overlapping fragments. In some embodiments, the virus is replicated and reactivated from 8-12 overlapping fragments. In some embodiments, the virus is replicated and reactivated from 10 overlapping fragments.

In some embodiments, the virus is reactivated using leporipox virus-catalyzed recombination and reactivation. In some embodiments, the leporipox virus is selected from the group consisting of: Shope fibroma virus (SFV), hare fibroma virus, rabbit fibroma virus, squirrel fibroma virus, and myxoma virus.

In certain aspects, the invention provides a synthetic chimeric horsepox virus (scHPXV) that is replicated and reactivated from synthetic DNA, the viral genome differing from a wild type genome of HPXV in that it is characterized by one or more modifications, the modifications being derived from a group comprising chemically synthesized DNA, cDNA or genomic DNA.

In some embodiments, the synthetic DNA is selected from one or more of: chemically synthesized DNA, PCR amplified DNA, engineered DNA and polynucleotides comprising nucleoside analogs. In some embodiments, the synthetic DNA is chemically synthesized DNA.

In some embodiments, the viral genome is based on the genome of HPXV strain MNR-76 and differs from the MNR-76 genome in that it is characterized by one or more modifications. In some embodiments, the one or more modifications comprise one or more deletions, insertions, substitutions, or a combination thereof.

In some embodiments, the one or more modifications comprise one or more modifications to introduce one or more unique restriction sites. In some embodiments, the one or more modifications are present in HPXV044 or HPXV095. In some embodiments, the one or more modifications comprise one or more mutations listed in Table 3. In some embodiments, the one or more modifications comprise one or more modifications to eliminate one or more restriction sites. In some embodiments, the one or more modifications comprise one or more modifications to eliminate one or more AarI restriction sites. In some embodiments, the one or more modifications comprise one or more modifications to eliminate all AarI restriction sites. In some embodiments, the one or more modifications comprise one or more modifications to eliminate one or more BsaI restriction sites. In some embodiments, the one or more modifications comprise one or more mutations listed in Table 2.

In some embodiments, the viral genome comprises heterologous terminal hairpin loops. In some embodiments, the viral genome comprises terminal hairpin loops derived from vaccinia virus. In some embodiments, the left and right terminal hairpin loops a) comprise the slow form and the fast form of the vaccinia virus terminal hairpin loop, respectively, b) comprise the fast form and the slow form of the vaccinia virus terminal hairpin loop, respectively, c) both comprise the slow form of the vaccinia virus terminal hairpin loop, or d) both comprise the fast form of the vaccinia virus terminal loop. In some embodiments, the slow form comprises a nucleotide sequence that is at least 85% identical to the sequence of SEQ ID NO: 11 and the fast form comprises a nucleotide sequence that is at least 85% identical to the nucleotide sequence of SEQ ID NO: 12. In some embodiments, the slow form comprises a nucleotide sequence that is at least 90% identical to the sequence of SEQ ID NO: 11 and the fast form comprises a nucleotide sequence that is at least 90% identical to the nucleotide sequence of SEQ ID NO: 12. In some embodiments, the slow form comprises a nucleotide sequence that is at least 95% identical to the sequence of SEQ ID NO: 11 and the fast form comprises a nucleotide sequence that is at least 95% identical to the nucleotide sequence of SEQ ID NO: 12. In some embodiments, the slow form consists of the nucleotide sequence of SEQ ID NO: 11 and the fast form consists of the nucleotide sequence of SEQ ID NO: 12. In some embodiments, the viral genome comprises terminal hairpin loops derived from camelpox virus, cowpox virus, ectromelia virus, monkeypox virus, variola virus, rabbitpox virus, raccoonpox virus, skunkpox virus, Taterapox virus, Uasin Gishu disease virus, or volepox virus.

In some embodiments, the virus is replicated and assembled from overlapping chemically synthesized DNA fragments that correspond to substantially all of the viral genome of HPXV.

In some embodiments, the virus is replicated and reactivated from 1-14 overlapping fragments. In some embodiments, the virus is replicated and reactivated from 8-12 overlapping fragments. In some embodiments, the virus is replicated and reactivated from 10 overlapping fragments.

In some embodiments, the virus is reactivated using leporipox virus-catalyzed recombination and reactivation. In some embodiments, the leporipox virus is selected from the group consisting of: Shope fibroma virus (SFV), hare fibroma virus, rabbit fibroma virus, squirrel fibroma virus, and myxoma virus.

In certain aspects, the invention provides a method of producing a synthetic chimeric poxvirus (scPV) comprising the steps of: (i) chemically synthesizing overlapping DNA fragments that correspond to substantially all of the viral genome of the poxvirus; (ii) transfecting the overlapping DNA fragments into helper virus-infected cells; (iii) culturing said cells to produce a mixture of helper virus and synthetic chimeric poxviral particles in said cells; and (iv) plating the mixture on host cells specific to the scPV to recover the scPV.

In some embodiments, the helper virus is a leporipox virus. In some embodiments, the leporipox virus is selected from the group consisting of: Shope fibroma virus (SFV), hare fibroma virus, rabbit fibroma virus, squirrel fibroma virus, and myxoma virus. In some embodiments, the leporipox virus is SFV.

In some embodiments, the helper virus is fowlpox virus.

In some embodiments, the helper virus is a psoralen-inactivated helper virus.

In some embodiments, the helper virus-infected cells are BGMK cells.

In some embodiments, step (i) further comprises chemically synthesizing terminal hairpin loops from a poxvirus and ligating them onto the fragments comprising the left and right termini of the viral genome.

In certain aspects, the invention provides a method of producing a synthetic chimeric orthopox virus (scOPV) comprising the steps of: (i) chemically synthesizing overlapping DNA fragments that correspond to substantially all of the viral genome of the OPV; (ii) transfecting the overlapping DNA fragments into helper virus-infected cells; (iii) culturing said cells to produce a mixture of helper virus and scOPV particles in said cells; and (iv) plating the mixture on OPV-specific host cells to recover the scOPV.

In some embodiments, the helper virus is a leporipox virus. In some embodiments, the leporipox virus is selected from the group consisting of: Shope fibroma virus (SFV), hare fibroma virus, rabbit fibroma virus, squirrel fibroma virus, and myxoma virus. In some embodiments, the leporipox virus is SFV.

In some embodiments, the helper virus is fowlpox virus.

In some embodiments, the helper virus is a psoralen-inactivated helper virus.

In some embodiments, the helper virus-infected cells are BGMK cells.

In some embodiments, the OPV-specific host cells are BSC-40 cells.

In some embodiments, the OPV is selected from the group consisting of: camelpox virus, cowpox virus, ectromelia virus, horsepox virus, monkeypox virus, vaccinia virus, variola virus, rabbitpox virus, raccoon poxvirus, skunkpox virus, Taterapox virus, Uasin Gishu disease virus, volepox virus.

In some embodiments, step (i) further comprises chemically synthesizing terminal hairpin loops from an OPV and ligating them onto the fragments comprising the left and right termini of the viral genome.

In certain aspects, the invention provides a method of producing a synthetic chimeric horsepox virus (scHPXV) comprising the steps of: (i) chemically synthesizing overlapping DNA fragments that correspond to substantially all of the HPXV genome; (ii) transfecting the overlapping DNA fragments into helper virus-infected cells; (iii) culturing said cells to produce a mixture of helper virus and scHPXV particles in said cells; and (iv) plating the mixture on HPXV-specific host cells to recover the scHPXV.

In certain aspects, the invention provides a method of producing a synthetic chimeric horsepox virus (scHPXV) comprising: (i) chemically synthesizing overlapping DNA fragments that correspond to substantially all of the HPXV genome; (ii) transfecting the overlapping DNA fragments into Shope fibroma virus (SFV)-infected cells; (iii) culturing said cells to produce a mixture of SFV and scHPXV particles in said cells; and (iv) plating the mixture on HPXV-specific host cells to recover the scHPXV.

In some embodiments, the helper virus is a leporipox virus. In some embodiments, the leporipox virus is selected from the group consisting of: Shope fibroma virus (SFV), hare fibroma virus, rabbit fibroma virus, squirrel fibroma virus, and myxoma virus. In some embodiments, the leporipox virus is SFV.

In some embodiments, the helper virus is fowlpox virus.

In some embodiments, the helper virus is a psoralen-inactivated helper virus.

In some embodiments, the helper virus-infected cells are BGMK cells.

In some embodiments, the HPXV-specific host cells are BSC-40 cells.

In some embodiments, step (i) further comprises chemically synthesizing terminal hairpin loops from an OPV and ligating them onto the fragments comprising the left and right termini of the HPXV genome.

In some embodiments, the overlapping DNA fragments comprise: i) nucleotide sequences that are at least 85% identical to the sequences of SEQ ID NOs: 1-10; ii) nucleotide sequences that are at least 90% identical to the sequences of SEQ ID NOs: 1-10; (iii) nucleotide sequences that are at least 95% identical to the sequences of SEQ ID NOs: 1-10; or (iv) nucleotide sequences that consist of the sequences of SEQ ID NOs: 1-10.

In some embodiments, the SFV-infected cells are BGMK cells.

In some embodiments, the HPXV-specific host cells are BSC-40 cells.

In certain aspects, the invention provides a synthetic chimeric poxvirus (scPV) generated by the methods of the disclosure.

In certain aspects, the invention provides a synthetic chimeric orthopox virus (scOPV) generated by the methods of the disclosure.

In certain aspects, the invention provides a synthetic chimeric horsepox virus (scHPXV) generated by methods of the disclosure.

In certain aspects, the invention provides compositions comprising a pharmaceutically acceptable carrier and an scPV of the disclosure.

In certain aspects, the invention provides compositions comprising a pharmaceutically acceptable carrier and an scOPV of the disclosure.

In certain aspects, the invention provides a method of triggering or boosting an immune response against variola virus, comprising administering to a subject in need thereof a composition comprising an scOPV of the disclosure.

In certain aspects, the invention provides a method of triggering or boosting an immune response against vaccinia virus, comprising administering to a subject in need thereof a composition comprising an scOPV of the disclosure.

In certain aspects, the invention provides a method of triggering or boosting an immune response against monkeypox virus, comprising administering to a subject in need thereof a composition comprising an scOPV of the disclosure.

In certain aspects, the invention provides a method of immunizing a human subject to protect said subject from variola virus infection, comprising administering to said subject a composition comprising an scOPV of the disclosure.

In certain aspects, the invention provides a method of treating a variola virus infection, comprising administering to a subject in need thereof a composition comprising an scOPV of the disclosure.

In certain aspects, the invention provides a composition comprising a pharmaceutically acceptable carrier and an scHPXV of the disclosure.

In certain aspects, the invention provides a method of triggering or boosting an immune response against variola virus, comprising administering to a subject in need thereof a composition comprising an scHPXV of the disclosure.

In certain aspects, the invention provides a method of triggering or boosting an immune response against vaccinia virus, comprising administering to a subject in need thereof a composition comprising an scHPXV of the disclosure.

In certain aspects, the invention provides a method of triggering or boosting an immune response against monkeypox virus, comprising administering to a subject in need thereof a composition comprising an scHPXV of the disclosure.

In certain aspects, the invention provides a method of immunizing a human subject to protect said subject from variola virus infection, comprising administering to said subject a composition comprising an scHPXV of the disclosure.

In certain aspects, the invention provides a method of treating a variola virus infection, comprising administering to a subject in need thereof a composition comprising an scHPXV of the disclosure.

In certain aspects, the invention provides a kit comprising a composition comprising an scPV of the disclosure.

In certain aspects, the invention provides a kit comprising a composition comprising an OPV of the disclosure.

In certain aspects, the invention provides a kit comprising a composition comprising the scHPXV of the disclosure.

In certain aspects, a composition of the invention is administered in a poxvirus treatment facility. In certain aspects, a poxvirus treatment facility is a facility wherein subjects in need of immunization or treatment with a composition or method of the invention may be immunized or treated in an environment such that they are sequestered from other subjects not intended to be immunized or treated or who might be potentially infected by the treated subject (e.g., caregivers and household members). In some embodiments, the subjects not intended to be immunized or potentially infected by the treated subject, include HIV patients, patients undergoing chemotherapy, patients undergoing treatment for cancer, rheumatologic disorders, or autoimmune disorders, patients who are undergoing or have received an organ or tissue transplant, patients with immune deficiencies, children, pregnant women, patients with atopic dermatitis, eczema, psoriasis, heart conditions, and patients on immunosuppressants, etc. In some embodiments, the poxvirus treatment facility is an orthopoxvirus treatment facility. In some embodiments, the poxvirus treatment facility is a smallpox treatment facility.

In certain aspects, a composition of the invention is administered by a specialist in smallpox adverse events. In some embodiments, the smallpox adverse events include but are not limited to eczema vaccinatum, progressive vaccinia, postvaccinal encephalitis, myocarditis, and dilated cardiomyopathy.

BRIEF DESCRIPTION OF THE DRAWINGS

This patent application contains at least one drawing executed in color. Copies of this patent application with color drawings will be provided by the Office upon request and payment of the necessary fee.

The foregoing summary, as well as the following detailed description of the invention, will be better understood when read in conjunction with the appended drawings. For the purpose of illustrating the invention there are shown in the drawings embodiment(s) which are presently preferred. It should be understood, however, that the invention is not limited to the precise arrangements and instrumentalities shown.

Figure 1A:
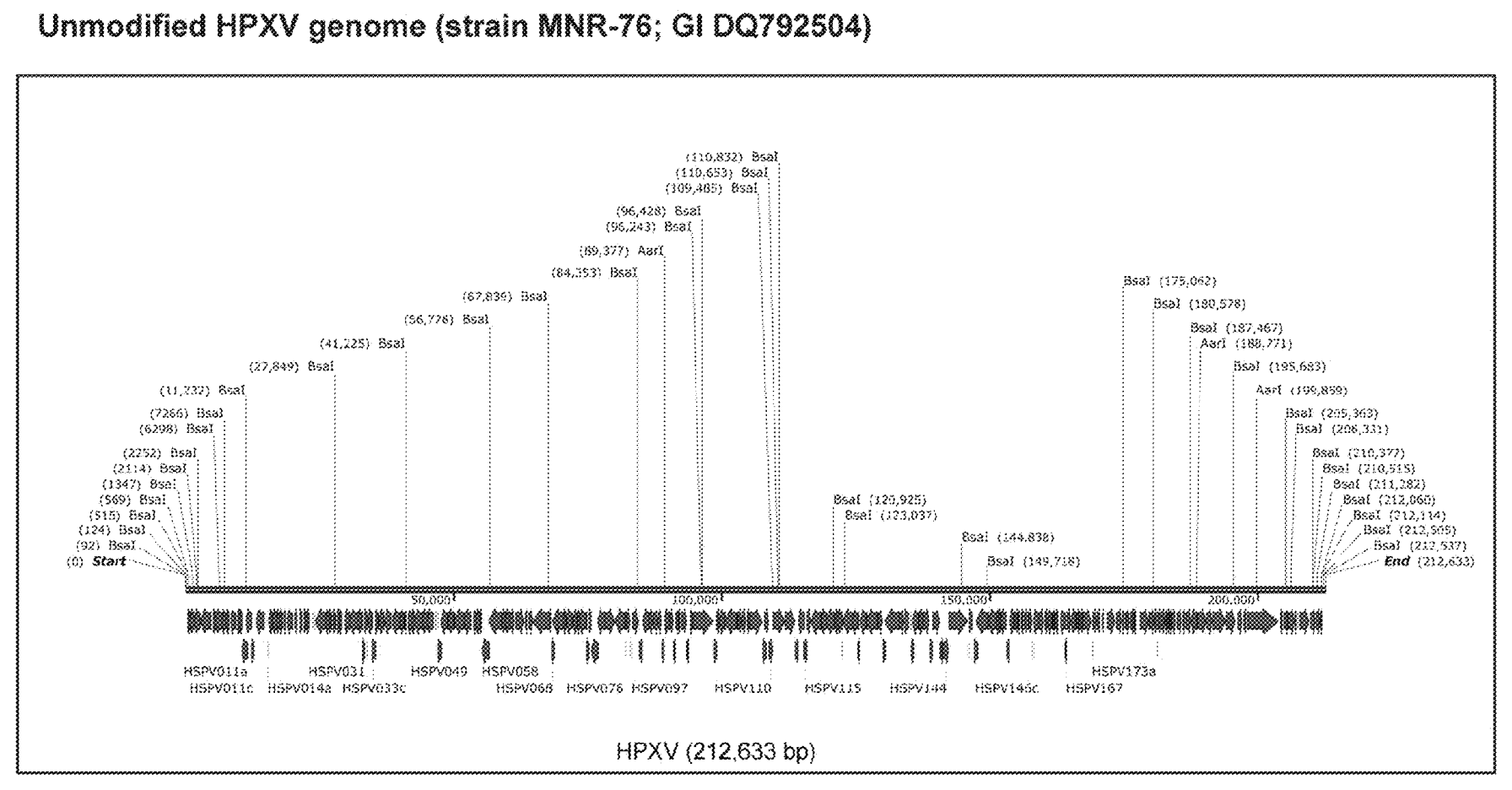

FIGS. 1A and 1B. Schematic representation of the linear dsDNA HPXV genome (strain MNR; Genbank Accession DQ792504). A. FIG. 1A illustrates the unmodified genome sequence of HPXV genome with individual HPXV genes (purple) and the naturally occurring AarI and BsaI sites indicated. B. FIG. 1B depicts the modified synthetic chimeric HPXV (scHPXV) genome that was chemically synthesized using the overlapping genomic DNA fragments (shown in red). The engineered SapI restriction sites that were used to ligate the VACV terminal hairpin loops onto the ITRs, along with the unmodified BsaI sites in the left and right ITR fragments, are also shown. The SapI sites were located in plasmid vector sites immediately to the left and right ends of the Left Inverted Terminal Repeat (LITR) and Right Inverted Terminal Repeat (RITR), respectively.

FIG. 2(A-C). Detailed schematic representation of the modified scHPXV YFP-gpt::095 genome and VACV (WR strain) terminal hairpin loops. A. FIG. 2A depicts the modified scHPXV YFP-gpt::095 genome. The unmodified BsaI sites are shown as blue lines on the genome. The novel AvaI and StuI restriction sites that were created in HPXV044 (the VACV F4L homolog) are also marked (green lines). The location of the selectable marker yellow fluorescent protein/guanosine phosphoribosyl transferase (yfp/gpt) in the HPXV095 locus (the VACV J2R homolog) of Frag_3 is also shown (yellow). B. FIG. 2B depicts the nucleotide sequence of the S (SEQ ID NO: 11) and F (SEQ ID NO: 12) forms of the terminal hairpin loop, and the color coding is explained in (C). C. FIG. 2C depicts the secondary structure predictions of the F and S forms of terminal hairpin loops that are covalently attached to the terminal ends of the linear dsDNA genomes of VACV. The terminal loop sequence is highlighted in green. The concatamer resolution sequence is boxed in red.

FIGS. 3A and 3B. The ~70 bp VACV terminal hairpin can be ligated to the left and right HPXV ITR fragments. A. FIG. 3A depicts a schematic diagram of the left and right HPXV ITR fragments marking the locations of the SapI and PvuII recognition sites. The predicted fragment sizes of the DNA following digestion with SapI and PvuII are shown. B. FIG. 3B depicts agarose gel electrophoresis of the left and right ITR fragments following ligation of the ~70 bp terminal hairpin to the 1472 bp ITR fragment cut with SapI. The ligated DNAs were subsequently cut with PvuII to facilitate detection of the small change in size caused by the addition of the hairpins.

FIGS. 4A-4C. PCR analysis and restriction digestion of scHPXV YFP-gpt::095 genomes confirm successful reactivation of scHPXV YFP-gpt::095. A. FIG. 4A depicts the results of PCR analysis of scHPXV YFP-gpt::095 clones. Primers that flank conserved BsaI restriction sites in both VACV and scHPXV YFP-gpt::095 were used to amplify a series of ~1 kbp products. The PCR products were subsequently digested with BsaI and the resulting DNA fragments were separated by agarose gel electrophoresis. VACV is cut, but all the BsaI sites have been deleted from two different scHPXV YFP-gpt::095 clones. B. FIG. 4B depicts pulse field gel electrophoresis (PFGE) of VACV-WR and scHPXV YFP-gpt::095 genomic DNAs. Virus DNAs was digested with BsaI, HindIII, or left untreated, and were then separated on a 1% Seakem gold agarose gel for 14 h at 14° C. at 5.7V/cm with a switch time of 1 to 10 seconds. A slight difference in size between the intact VACV and scHPXV YFP-gpt::095 genomes was observed. The faint bands marked with an asterisk (*) are either incomplete DNA digestion products or could be cut mitochondrial DNA fragments that often contaminate VACV virion preparations. C. FIG. 4C depicts conventional agarose gel electrophoresis of VACV-WR and scHPXV YFP-gpt::095 genomic DNA digested with BsaI or HindIII. DNA fragments were visualized by staining gels with SybrGold DNA stain.

FIGS. 5A-5C. ScHPXV YFP-gpt::095 grows like other Orthopoxviruses but exhibits a small plaque phenotype in BSC-40 cells. A. FIG. 5A illustrates the multi-step growth of VACV-WR, DPP15, CPXV, and scHPXV YFP-gpt::095 in BSC-40 (top left panel), HeLa (top middle panel), primary HEL (top right panel), and Vero (bottom left panel) cell lines. B. FIG. 5B illustrates plaque size comparisons between VACV-WR, DPP15, CPXV, and scHPXV YFP-gpt::095. BSC-40 cells were infected with the indicated viruses and at 48 h post infection the cells were fixed and stained. The areas (in arbitrary units [A.U.]) of 24 plaques over three independent experiments were measured for each virus. Data are expressed as the mean plaque diameter. , $P<0.01$; , $P<0.0001$. C. FIG. 5**C depicts plaque morphology of BSC-40 cells infected with the indicated viruses for 72 h. Cells were fixed, stained, and scanned for visualization.

FIG. 6. Schematic representation of the linear dsDNA genome of VACV (strain ACAM2000; Genbank Accession AY313847). The unmodified genome sequence of VACV ACAM2000 is illustrated with naturally occurring AarI and BsaI recognition sites marked. The overlapping DNA fragments are depicted in blue. The left (LITR_ACAM2000) and right (RITR_ACAM2000) fragments are shown in orange.

FIG. 7. A graphical representation of the % weight loss over time after administration of various compositions and doses to mice. The depicted data are generated from groups of 5 female BALB/c mice that are inoculated with the indicated dose of scHPXV YFP-gpt::095 (also designated as scHPXV (ΔHPXV_095/J2R) or scHPXV (yfp/gpt)), scHPXV (wt), Dryvax DPP15, or VACV WR in 10 μl of PBS. Mice are weighed daily for 28 days and any that lost >25% of their initial weight are euthanized. Data points represent mean scores, and error bars represent standard deviation.

Figure 8B:
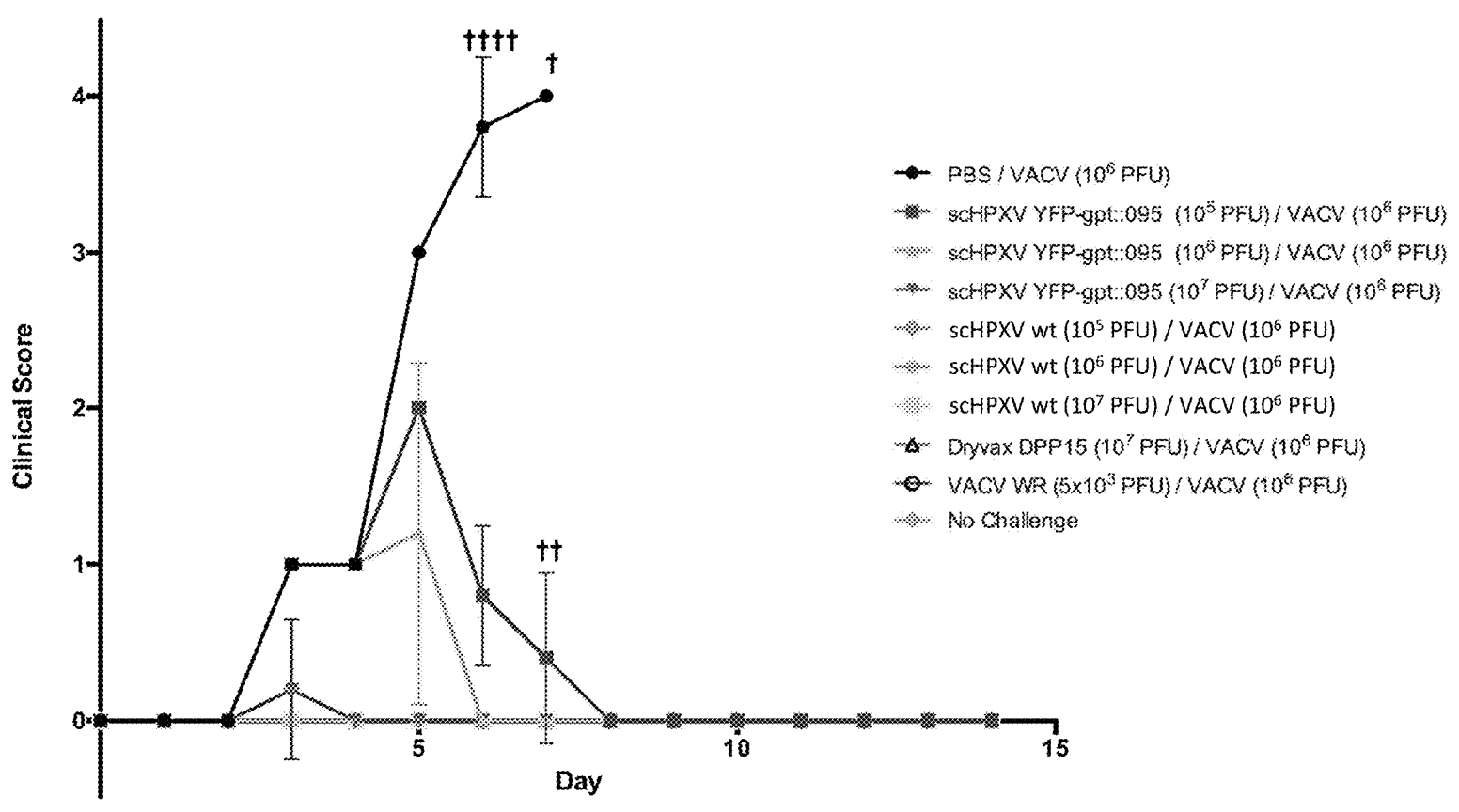

FIGS. 8A and 8B. Graphical representations of the % weight loss over time after administration of various compositions and doses to mice. The depicted data are generated from mice that are previously vaccinated (FIG. 7) and who are then challenged with a lethal dose of VACV WR ($10^6$ PFU) intranasally. FIG. 8A shows the weight changes and FIG. 8B shows the clinical scores in mice recorded daily for 13 days. Any mice that lost >25% of their initial weight are euthanized. Mice are assigned a clinical score based upon the appearance of ruffled fur, hunched posture, difficulty breathing, and decreased mobility. Data points represent mean differences in weights or scores, and error bars represent standard deviation. † indicate the number of mice that succumb to the VACV infection on a given day.

FIG. 9. Graphical representation of the % survival over time after administration of various compositions and doses to mice. The depicted data are generated from mice that are previously vaccinated (FIG. 7) and who are then challenged with a lethal dose of VACV WR ($10^6$ PFU) intranasally.

FIGS. 11A-11C. Growth properties of scHPXV versus scHPXV YFP-gpt::095. A. Plaque size measurements. Homologous recombination was used to replace the YFP-gpt locus in scHPXV YFP-gpt::095 with thymidine kinase gene sequences. This produced a virus with a fully wild-type complement of HPXV genes (scHPXV). BSC-40 cells were infected with the indicated viruses and cultured for three days. The dishes were stained and the plaque areas measured using a scanned digital image. Statistically significant differences are noted ****$P<0.0001$). B. Plaque images. C. Multi-step virus growth in culture. The indicated cell lines were infected with scHPXV or scHPXV YFP-gpt::095 at a multiplicity of infection of 0.01, the virus harvested at the indicated times, and titrated on BSC-40 cells in triplicate. No significant differences in the growth of these viruses were detected in these in vitro assays.

DETAILED DESCRIPTION OF THE INVENTION

General Techniques

Figure 1B:
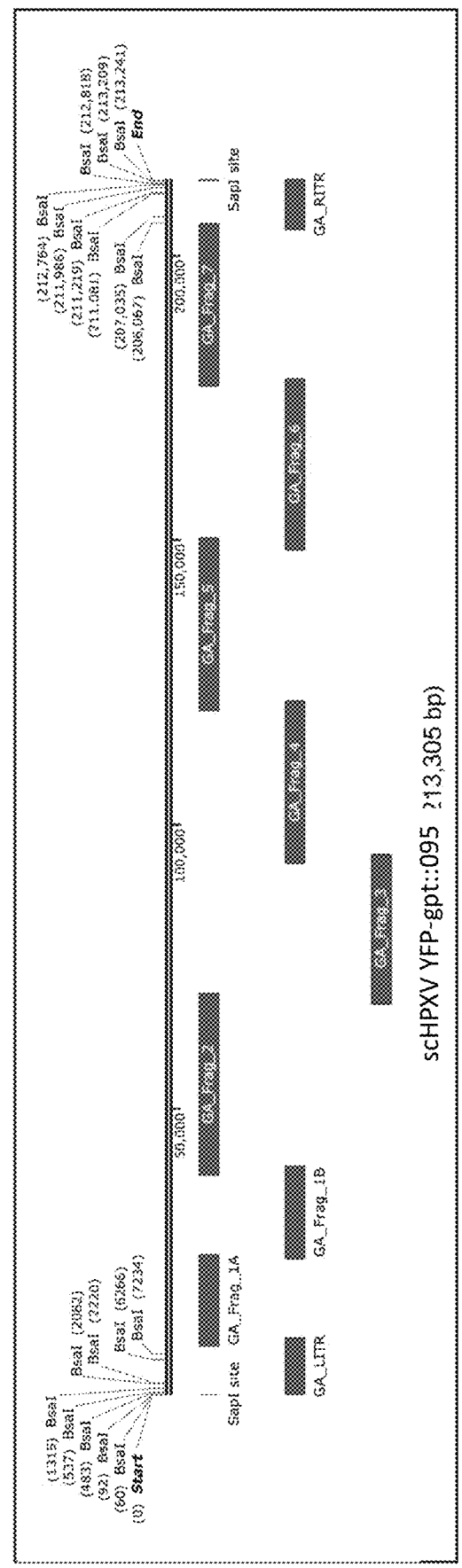
Figure 3A:
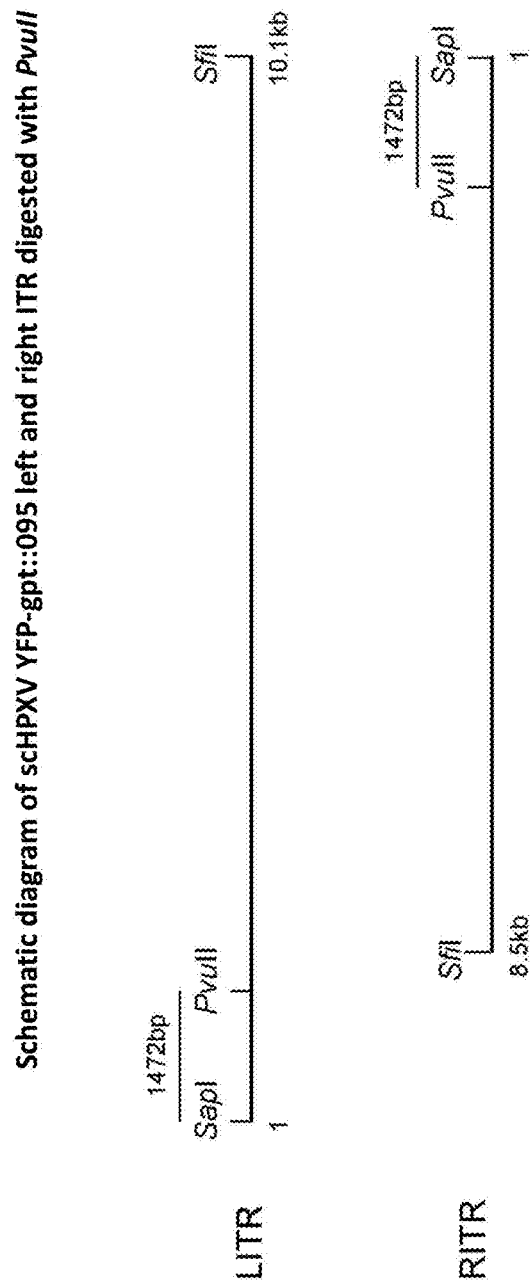
Figure 3B:
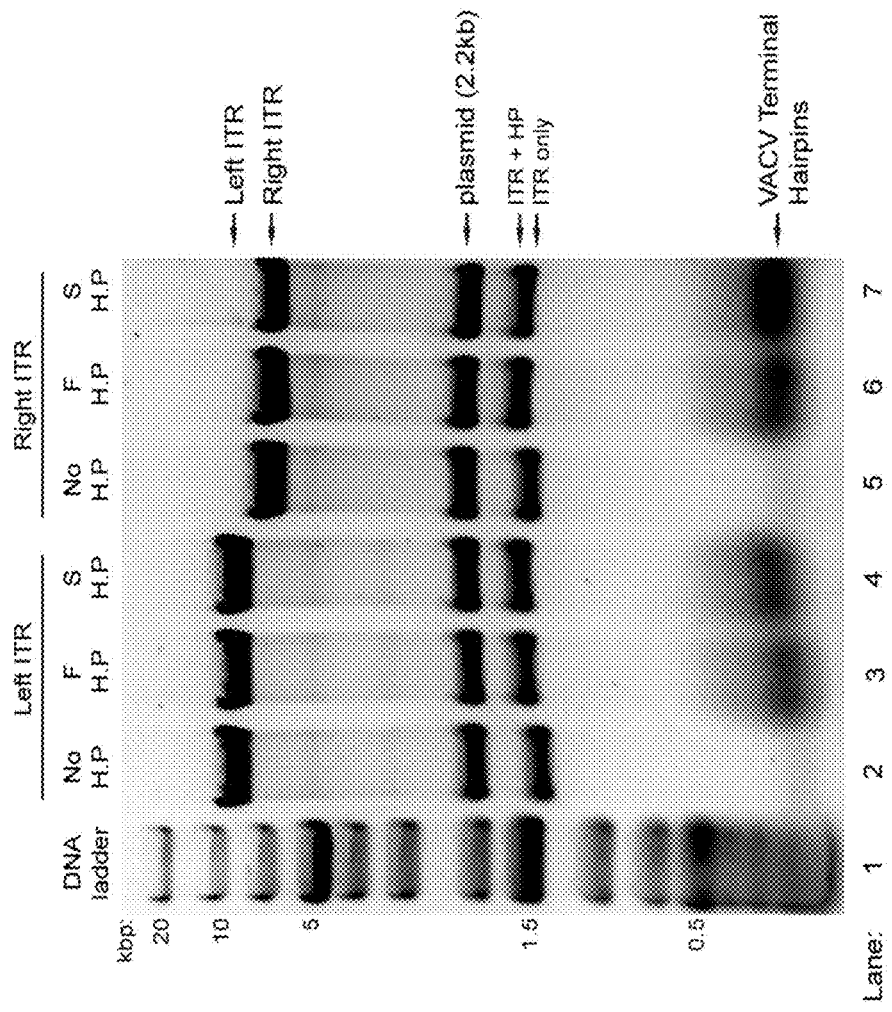

Unless otherwise defined herein, scientific and technical terms used in this application shall have the meanings that are commonly understood by those of ordinary skill in the art. Generally, nomenclature used in connection with, and techniques of, pharmacology, cell and tissue culture, molecular biology, cell and cancer biology, neurobiology, neurochemistry, virology, immunology, microbiology, genetics and protein and nucleic acid chemistry, described herein, are those well-known and commonly used in the art. In case of conflict, the present specification, including definitions, will control.

The practice of the present invention will employ, unless otherwise indicated, conventional techniques of molecular biology (including recombinant techniques), microbiology, cell biology, biochemistry and immunology, which are within the skill of the art. Such techniques are explained fully in the literature, such as Molecular Cloning: A Laboratory Manual, second edition (Sambrook et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-1998) J. Wiley and Sons; Methods in Enzymology (Academic Press, Inc.); Gene Transfer Vectors for Mammalian Cells (J. M. Miller and M. P. Calos, eds., 1987); Current Protocols in Molecular Biology (F. M. Ausubel et al., eds., 1987); PCR: The Polymerase Chain Reaction, (Mullis et al., eds., 1994); Sambrook and Russell, Molecular Cloning: A Laboratory Manual, 3rd. ed., Cold Spring Harbor Laboratory Press, Cold Spring Harbor, N.Y. (2001); Ausubel et al., Current Protocols in Molecular Biology, John Wiley & Sons, N.Y. (2002); Harlow and Lane Using Antibodies: A Laboratory Manual, Cold Spring Harbor Laboratory Press, Cold Spring Harbor, N.Y. (1998); Coligan et al., Short Protocols in Protein Science, John Wiley & Sons, N Y (2003); Short Protocols in Molecular Biology (Wiley and Sons, 1999).

Enzymatic reactions and purification techniques are performed according to manufacturer's specifications, as commonly accomplished in the art or as described herein. The nomenclatures used in connection with, and the laboratory procedures and techniques of, analytical chemistry, biochemistry, immunology, molecular biology, synthetic organic chemistry, and medicinal and pharmaceutical chemistry described herein are those well known and commonly used in the art. Standard techniques are used for chemical syntheses, and chemical analyses.

Throughout this specification and embodiments, the word "comprise," or variations such as "comprises" or "comprising," will be understood to imply the inclusion of a stated integer or group of integers but not the exclusion of any other integer or group of integers.

It is understood that wherever embodiments are described herein with the language "comprising," otherwise analogous embodiments described in terms of "consisting of" and/or "consisting essentially of" are also provided.

The term "including" is used to mean "including but not limited to." "Including" and "including but not limited to" are used interchangeably.

Any example(s) following the term "e.g." or "for example" is not meant to be exhaustive or limiting.

Unless otherwise required by context, singular terms shall include pluralities and plural terms shall include the singular.

The articles "a", "an" and "the" are used herein to refer to one or to more than one (i.e., to at least one) of the grammatical object of the article. By way of example, "an element" means one element or more than one element. Reference to "about" a value or parameter herein includes (and describes) embodiments that are directed to that value or parameter per se. For example, description referring to "about X" includes description of "X." Numeric ranges are inclusive of the numbers defining the range.

Notwithstanding that the numerical ranges and parameters setting forth the broad scope of the invention are approximations, the numerical values set forth in the specific examples are reported as precisely as possible. Any numerical value, however, inherently contains certain errors necessarily resulting from the standard deviation found in their respective testing measurements. Moreover, all ranges disclosed herein are to be understood to encompass any and all subranges subsumed therein. For example, a stated range of "1 to 10" should be considered to include any and all subranges between (and inclusive of) the minimum value of 1 and the maximum value of 10; that is, all subranges beginning with a minimum value of 1 or more, e.g., 1 to 6.1, and ending with a maximum value of 10 or less, e.g., 5.5 to 10.

Where aspects or embodiments of the invention are described in terms of a Markush group or other grouping of alternatives, the present invention encompasses not only the entire group listed as a whole, but each member of the group individually and all possible subgroups of the main group, and also the main group absent one or more of the group members. The present invention also envisages the explicit exclusion of one or more of any of the group members in the embodimented invention.

Exemplary methods and materials are described herein, although methods and materials similar or equivalent to those described herein can also be used in the practice or testing of the present invention. The materials, methods, and examples are illustrative only and not intended to be limiting.

Definitions

The following terms, unless otherwise indicated, shall be understood to have the following meanings:

As used herein, the terms "wild type virus", "wild type genome", "wild type protein," or "wild type nucleic acid" refer to a sequence of amino or nucleic acids that occurs naturally within a certain population (e.g., a particular viral species, etc.).

The terms "chimeric" or "engineered" or "modified" (e.g., chimeric poxvirus, engineered polypeptide, modified polypeptide, engineered nucleic acid, modified nucleic acid) or grammatical variations thereof are used interchangeably herein to refer to a non-native sequence that has been manipulated to have one or more changes relative a native sequence.

As used herein, "synthetic virus" refers to a virus initially derived from synthetic DNA (e.g., chemically synthesized DNA, PCR amplified DNA, engineered DNA, polynucleotides comprising nucleoside analogs, etc., or combinations thereof) and includes its progeny, and the progeny may not necessarily be completely identical (in morphology or in genomic DNA complement) to the original parent synthetic virus due to natural, accidental, or deliberate mutation. In some embodiments, the synthetic virus refers to a virus where substantially all of the viral genome is initially derived from chemically synthesized DNA.

As outlined elsewhere herein, certain positions of the viral genome can be altered. By "position" as used herein is meant a location in the genome sequence. Corresponding positions are generally determined through alignment with other parent sequences.

As used herein, "residue" refers to a position in a protein and its associated amino acid identity.

As known in the art, "polynucleotide," or "nucleic acid," as used interchangeably herein, refer to chains of nucleotides of any length, and include DNA and RNA. The nucleotides can be deoxyribonucleotides, ribonucleotides, modified nucleotides or bases, and/or their analogs, or any substrate that can be incorporated into a chain by DNA or RNA polymerase. A polynucleotide may comprise modified nucleotides, such as methylated nucleotides and their analogs. If present, modification to the nucleotide structure may be imparted before or after assembly of the chain. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog; internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.); those containing pendant moieties, such as, for example, proteins (e.g., nucleases, toxins, antibodies, signal peptides, poly-L-lysine, etc.); those with intercalators (e.g., acridine, psoralen, etc.); those containing chelators (e.g., metals, radioactive metals, boron, oxidative metals, etc.); those containing alkylators; those with modified linkages (e.g., alpha anomeric nucleic acids, etc.); as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha- or beta-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

The terms "polypeptide", "oligopeptide", "peptide" and "protein" are used interchangeably herein to refer to chains of amino acids of any length. The chain may be linear or branched, it may comprise modified amino acids, and/or may be interrupted by non-amino acids. The terms also encompass an amino acid chain that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that the polypeptides can occur as single chains or associated chains.

"Homologous," in all its grammatical forms and spelling variations, refers to the relationship between two proteins that possess a "common evolutionary origin," including proteins from superfamilies in the same species of organism, as well as homologous proteins from different species of organism. Such proteins (and their encoding nucleic acids)

have sequence homology, as reflected by their sequence similarity, whether in terms of percent identity or by the presence of specific residues or motifs and conserved positions.

However, in common usage and in the instant application, the term "homologous," when modified with an adverb such as "highly," may refer to sequence similarity and may or may not relate to a common evolutionary origin.

The term "sequence similarity," in all its grammatical forms, refers to the degree of identity or correspondence between nucleic acid or amino acid sequences that may or may not share a common evolutionary origin.

"Percent (%) sequence identity" with respect to a reference polypeptide (or nucleotide) sequence is defined as the percentage of amino acid residues (or nucleic acids) in a candidate sequence that are identical with the amino acid residues (or nucleic acids) in the reference polypeptide (nucleotide) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

As used herein, a "host cell" includes an individual cell or cell culture that can be or has been a recipient for vector(s) for incorporation of polynucleotide inserts. Host cells include progeny of a single host cell, and the progeny may not necessarily be completely identical (in morphology or in genomic DNA complement) to the original parent cell due to natural, accidental, or deliberate mutation. A host cell includes cells transfected and/or transformed in vivo with a nucleic acid of this invention.

As used herein, "vector" means a construct, which is capable of delivering, and, preferably, expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors encapsulated in liposomes, and certain eukaryotic cells, such as producer cells.

As used herein, "expression control sequence" means a nucleic acid sequence that directs transcription of a nucleic acid. An expression control sequence can be a promoter, such as a constitutive or an inducible promoter, or an enhancer. The expression control sequence is operably linked to the nucleic acid sequence to be transcribed.

As used herein, "isolated molecule" (where the molecule is, for example, a polypeptide, a polynucleotide, or fragment thereof) is a molecule that by virtue of its origin or source of derivation (1) is not associated with one or more naturally associated components that accompany it in its native state, (2) is substantially free of one or more other molecules from the same species (3) is expressed by a cell from a different species, or (4) does not occur in nature. Thus, a molecule that is chemically synthesized, or expressed in a cellular system different from the cell from which it naturally originates, will be "isolated" from its naturally associated components. A molecule also may be rendered substantially free of naturally associated components by isolation, using purification techniques well known in the art. Molecule purity or homogeneity may be assayed by a number of means well known in the art. For example, the purity of a polypeptide sample may be assayed using polyacrylamide gel electrophoresis and staining of the gel to visualize the polypeptide using techniques well known in the art. For certain purposes, higher resolution may be provided by using HPLC or other means well known in the art for purification.

As used herein, the term "isolated", in the context of viruses, refers to a virus that is derived from a single parental virus. A virus can be isolated using routine methods known to one of skill in the art including, but not limited to, those based on plaque purification and limiting dilution.

As used herein, the phrase "multiplicity of infection" or "MOI" is the average number of viruses per infected cell. The MOI is determined by dividing the number of virus added (ml addedxplaque forming units (PFU)) by the number of cells added (ml addedx cells/ml).

As used herein, "purify," and grammatical variations thereof, refers to the removal, whether completely or partially, of at least one impurity from a mixture containing the polypeptide and one or more impurities, which thereby improves the level of purity of the polypeptide in the composition (i.e., by decreasing the amount (ppm) of impurity(ies) in the composition). As used herein "purified" in the context of viruses refers to a virus which is substantially free of cellular material and culture media from the cell or tissue source from which the virus is derived. The language "substantially free of cellular material" includes preparations of virus in which the virus is separated from cellular components of the cells from which it is isolated or recombinantly produced. Thus, virus that is substantially free of cellular material includes preparations of protein having less than about 30%, 20%, 10%, or 5% (by dry weight) of cellular protein (also referred to herein as a "contaminating protein"). The virus is also substantially free of culture medium, i.e., culture medium represents less than about 20%, 10%, or 5% of the volume of the virus preparation. A virus can be purified using routine methods known to one of skill in the art including, but not limited to, chromatography and centrifugation.

As used herein, "substantially pure" refers to material which is at least 50% pure (i.e., free from contaminants), more preferably, at least 90% pure, more preferably, at least 95% pure, yet more preferably, at least 98% pure, and most preferably, at least 99% pure.

The terms "patient", "subject", or "individual" are used interchangeably herein and refer to either a human or a non-human animal. These terms include mammals, such as humans, primates, livestock animals (including bovines, porcines, camels, etc.), companion animals (e.g., canines, felines, etc.) and rodents (e.g., mice and rats).

As used herein, the terms "prevent", "preventing" and "prevention" refer to the prevention of the recurrence or onset of, or a reduction in one or more symptoms of a disease (e.g., a poxviral infection) in a subject as a result of the administration of a therapy (e.g., a prophylactic or therapeutic agent). For example, in the context of the administration of a therapy to a subject for an infection, "prevent", "preventing" and "prevention" refer to the inhibition or a reduction in the development or onset of an infection (e.g., a poxviral infection or a condition associated therewith), or the prevention of the recurrence, onset, or development of one or more symptoms of an infection (e.g., a poxviral infection or a condition associated therewith), in a subject resulting from the administration of a therapy (e.g., a prophylactic or therapeutic agent), or the administration of a combination of therapies (e.g., a combination of prophylactic or therapeutic agents).

"Treating" a condition or patient refers to taking steps to obtain beneficial or desired results, including clinical results. With respect to infections (e.g., a poxviral infection), treatment refers to the eradication or control of the replication of an infectious agent (e.g., a poxvirus), the reduction in the numbers of an infectious agent (e.g., the reduction in the titer of poxvirus), the reduction or amelioration of the progression, severity, and/or duration of an infection (e.g., a poxviral infection or a condition or symptoms associated therewith), or the amelioration of one or more symptoms resulting from the administration of one or more therapies (including, but not limited to, the administration of one or more prophylactic or therapeutic agents).

With respect to cancer, treatment refers to the eradication, removal, modification, or control of primary, regional, or metastatic cancer tissue that results from the administration of one or more therapeutic agents of the invention. In certain embodiments, such terms refer to the minimizing or delaying the spread of cancer resulting from the administration of one or more therapeutic agents of the invention to a subject with such a disease. In other embodiments, such terms refer to elimination of disease-causing cells.

"Administering" or "administration of" a substance, a compound or an agent to a subject can be carried out using one of a variety of methods known to those skilled in the art. For example, a compound or an agent can be administered sublingually or intranasally, by inhalation into the lung or rectally. Administering can also be performed, for example, once, a plurality of times, and/or over one or more extended periods. In some aspects, the administration includes both direct administration, including self-administration, and indirect administration, including the act of prescribing a drug. For example, as used herein, a physician who instructs a patient to self-administer a drug, or to have the drug administered by another and/or who provides a patient with a prescription for a drug is administering the drug to the patient.

Each embodiment described herein may be used individually or in combination with any other embodiment described herein.

Overview

Poxviruses are large (~200 kbp) DNA viruses that replicate in the cytoplasm of infected cells. The Orthopoxvirus (OPV) genus comprises a number of poxviruses that vary greatly in their ability to infect different hosts. Vaccinia virus (VACV), for example, can infect a broad group of hosts, whereas variola virus (VARV), the causative agent of smallpox, only infects humans. A feature common to many, if not all poxviruses, is their ability to non-genetically "reactivate" within a host. Non-genetic reactivation refers to a process wherein cells infected by one poxvirus can promote the recovery of a second "dead" virus (for example one inactivated by heat) that would be non-infectious on its own.

Purified poxvirus DNA is not infectious because the virus life cycle requires transcription of early genes via the virus-encoded RNA polymerases that are packaged in virions. However, this deficiency can be overcome if virus DNA is transfected into cells previously infected with a helper poxvirus, providing the necessary factors needed to transcribe, replicate, and package the transfected genome in trans (Sam C K, Dumbell KR. Expression of poxvirus DNA in coinfected cells and marker rescue of thermosensitive mutants by subgenomic fragments of DNA. Ann Virol (Inst Past). 1981; 132:135-50). Although this produces mixed viral progeny, the problem can be overcome by performing the reactivation reaction in a cell line that supports the propagation of both viruses, and then eliminating the helper virus by plating the mixture of viruses on cells that do not support the helper virus' growth (Scheiflinger F, Dorner F, Falkner F G. Construction of chimeric vaccinia viruses by molecular cloning and packaging. Proceedings of the National Academy of Sciences of the United States of America. 1992; 89(21):9977-81).

Previously, a method where the high-frequency recombination reactions catalyzed by a Leporipoxvirus, Shope fibroma virus (SFV), can be coupled with an SFV-catalyzed reactivation reaction, to rapidly assemble recombinant VACV strains using multiple overlapping fragments of viral DNA (Yao X D, Evans D H. High-frequency genetic recombination and reactivation of orthopoxviruses from DNA fragments transfected into leporipoxvirus-infected cells. Journal of Virology. 2003; 77(13):7281-90). For the first time, the reactivation and characterization of a functional poxvirus (synthetic chimeric horsepox virus [scHPXV]) using chemically synthesized, overlapping double-stranded DNA fragments is described. The principles can be analogously applied and extrapolated to other poxviruses, including but not limited to camelpox virus (CMLV), cowpox virus (CPXV), ectromelia virus (ECTV, "mousepox agent"), horsepox (HPXV), monkeypox virus (MPXV), rabbitpox virus (RPXV), raccoonpox virus, skunkpox virus, Taterapox virus, Uasin Gishu disease virus, vaccinia virus (VACV), and volepox virus (VPV).

It is further shown here that one embodiment of a synthetic chimeric poxvirus of the invention (e.g., a synthetic chimeric horsepox virus), can infect and immunize mice against a lethal VACV challenge and can do so without causing any disease during the initial immunization step.

Synthetic Chimeric Poxviruses of the Invention

The invention provides functional synthetic chimeric poxviruses (scPVs) that are initially replicated and assembled from chemically synthesized DNA. The viruses that may be produced in accordance with the methods of the invention can be any poxvirus whose genome has been sequenced in large part or for which a natural isolate is available. An scPV of the invention may be based on the genome sequences of naturally occurring strains, variants or mutants, mutagenized viruses or genetically engineered viruses. The viral genome of an scPV of the invention comprises one or more modifications relative to the wild type genome or base genome sequence of said virus. The modifications may include one or more deletions, insertions, substitutions, or combinations thereof. It is understood that the modifications may be introduced in any number of ways commonly known in the art. The modified portions of the genome may be derived from chemically synthesized DNA, cDNA or genomic DNA.

Chemical genome synthesis is particularly useful when a natural template is not available for genetic modification, amplification, or replication by conventional molecular biology methods. For example, a natural isolate of horsepox virus (HPXV) is not readily available to obtain template DNA but the genome sequence for HPXV (strain MNR-76) has been described. The HPXV genome sequence, however, is incomplete. The sequence of the terminal hairpin loops was not determined. In a surprising result, a functional synthetic chimeric HPXV (scHPXV) was generated by using terminal hairpin loops based on VACV telomeres in lieu of HPXV terminal hairpin loop sequences. In some embodiments, the poxvirus belongs to the Chordopoxvirinae subfamily. In some embodiments, the poxvirus belongs to a genus of Chordopoxvirinae subfamily selected from Avipoxvirus, Capripoxvirus, Cervidpoxvirus, Crocodylipoxvirus, Leporipoxvirus, Molluscipoxvirus, Orthopoxvirus, Parapoxvirus, Suipoxvirus, or Yatapoxvirus. In some embodiments, the poxvirus is an Orthopoxvirus. In some embodiments, the Orthopoxvirus is selected from camelpox virus (CMLV), cowpox virus (CPXV), ectromelia virus (ECTV, "mousepox agent"), HPXV, monkeypox virus (MPXV), rabbitpox virus (RPXV), raccoonpox virus, skunkpox virus, Taterapox virus, Uasin Gishu disease virus, vaccinia virus (VACV), variola virus (VARV) and volepox virus (VPV). In a preferred embodiment, the poxvirus is an HPXV. In another preferred embodiment, the poxvirus is a VACV. In some embodiments, the poxvirus is a Parapoxvirus. In some embodiments, the Parapoxvirus is selected from orf virus (ORFV), pseudocowpox virus (PCPV), bovine popular stomatitis virus (BPSV), squirrel parapoxvirus (SPPV), red deer parapoxvirus, Ausdyk virus, Chamois contagious ecythema virus, reindeer parapoxvirus, or sealpox virus. In some embodiments, the poxvirus is aMolluscipoxvirus. In some embodiments, the Molluscipoxvirus is molluscum contagiousum virus (MCV). In some embodiments, the poxvirus is a Yatapoxvirus. In some embodiments, the Yatapoxvirus is selected from Tanapox virus or Yaba monkey tumor virus (YMTV). In some embodiments, the poxvirus is a Capripoxvirus. In some embodiments, the Capripoxvirus is selected from sheeppox, goatpox, or lumpy skin disease virus. In some embodiments, the poxvirus is a Suipoxvirus. In some embodiments, the Suipoxvirus is swinepox virus. In some embodiments, the poxvirus is a Leporipoxvirus. In some embodiments, the Leporipoxvirus is selected from myxoma virus, Shope fibroma virus (SFV), squirrel fibroma virus, or hare fibroma virus. New poxviruses (e.g., Orthopoxviruses) are still being constantly discovered. It is understood that an scPV of the invention may be based on such a newly discovered poxvirus.

Chemical viral genome synthesis also opens up the possibility of introducing a large number of useful modifications to the resulting genome or to specific parts of it. The modifications may improve ease of cloning to generate the virus, provide sites for introduction of recombinant gene products, improve ease of identifying reactivated viral clones and/or confer a plethora of other useful features (e.g., introducing a desired antigen, producing an oncolytic virus, etc.). In some embodiments, the modifications may include the attenuation or deletion of one or more virulence factors. In some embodiments, the modifications may include the addition or insertion of one or more virulence regulatory genes or gene-encoding regulatory factors.

Traditionally, the terminal hairpins of poxviruses have been difficult to clone and sequence, hence, it is not surprising that some of the published genome sequences (e.g., VACV, ACAM 2000 and HPXV MNR-76) are incomplete. The published sequence of the HPXV genome is likewise incomplete, probably missing ~60 bp from the terminal ends. Thus, the HPXV hairpins cannot be precisely replicated and prior to this invention, it was not known whether HPXV could be replicated and assembled from polynucleotides based on only the known portion of the HPXV genome. Nor was it known that hairpins from one virus would be operable in another. In an exemplary embodiment, 129 nt ssDNA fragments were chemically synthesized using the published sequence of the VACV telomeres as a guide and ligated onto dsDNA fragments comprising left and right ends of the HPXV genome. In some embodiments, the terminal hairpins of an scPV of the invention are derived from VACV. In some embodiments, the terminal hairpins are derived from CMLV, CPXV, ECTV, HPXV, MPXV, RPXV, raccoonpox virus, skunkpox virus, Taterapox virus, Uasin Gishu disease virus or VPV. In some embodiments, the terminal hairpins are based on the terminal hairpins of any poxvirus whose genome has been completely sequenced or a natural isolate of which is available for genome sequencing.

In some embodiments, the modifications may include the deletion of one or more restriction sites. In some embodiments, the modifications may include the introduction of one or more restriction sites. In some embodiments, the restriction sites to be deleted from the genome or added to the genome may be selected from one or more of restriction sites such as but not limited to AanI, AarI, AasI, AatI, AatII, AbaSI, AbsI, Acc65I, AccI, AccII, AccIII, AciI, AcII, AcuI, AfeI, AflII, AflIII, AgeI, AhdI, AleI, AluI, AlwI, AlwNI, ApaI, ApaLI, ApeKI, ApoI, AscI, AseI, AsiSI, AvaI, AvaII, AvrII, BaeGI, BaeI, BamHI BanI, BanII, BbsI, BbvCI, BbvI, BccI, BceAI, BcgI, BciVI, BclI, BcoDI, BfaI, BfuAI, BfuCI, BglI, BglII, BlpI, BmgBI, BmrI, BmtI, BpmI, Bpu10I, BpuEI, BsaAI, BsaBI, BsaHI, BsaI, BsaJI, BsaWI, BsaXI, BseRI, BseYI, BsgI, BsiEI, BsiHKAI, BsiWI, BslI, BsmAI, BsmBI, BsmFI, BsmI, BsoBI, Bsp1286I, BspCNI, BspDI, BspEI, BspHI, BspMI, BspQI, BsrBI, BsrDI, BsrFaI, BsrGI, BsrI, BssHII, BssSαI, BstAPI, BstBI, BstEII, BstNI, BstUI, BstXI, BstYI, BstZ17I, Bsu36I, BtgI, BtgZI, BtsαI, BtsCI, BtsIMutI, Cac8I, ClaI, CspCI, CviAII, CviKI-1, CviQI, DdeI, DpnI, DpnII, DraI, DrdI, EaeI, EagI, EarI, EciI, Eco53kI, EcoN, EcoO109I, EcoPi5I, EcoRI, EcoRV, FatI, FauI, Fnu4HI, FokI, FseI, FspEI, FspI, HaeII, HaeIII, HgaI, HhaI, HincI, HindIII, HinfI, HinP1I, HpaI, HpaII, HphI, Hpy166II, Hpy188I, Hpy188III, Hpy99I, HpyAV, HpyCH4III, HpyCH4IV, HpyCH4V, I-CeuI, I-SceI, KasI, KpnI, LpnPI, MboI, MboII, MfeI, MluCI, MluI, MlyI, MmeI, MnlI, MscI, MseI, MslI, MspA1I, MspI, MspJI, MwoI, NaeI, NarI, NciI, NcoI, NdeI, NgoMIV, NheI, NlaIII, NlaIV, NmeAIII, NotI, NruI, NsiI, NspI, PacI, PaeR7I, PciI, PflFI, PflMI, PleI, PluTI, PmeI, PmlI, PpuMI, PshAI, PsiI, PspGI, PspOMI, PspXI, PstI, PvuI, PvuII, RsaI, RsrII, SacI, SacII, SalI, SapI, Sau3AI, Sau96I, SbfI, ScrFI, SexAI, SfaNI, SfcI, SfiI, SfoI, SgrAI, SmaI, SmlI, SnaBI, SpeI, SphI, SrfI, SspI, StuI, StyD4I, StyI, SwaI, TαqαI, TfiI, TseI, Tsp45I, TspMI, TspRI, Tth111I, XbaI, XcmI, XhoI, XmaI, XmnI, or ZraI. It is understood that any desired restriction site(s) or combination of restriction sites may be inserted into the genome or mutated and/or eliminated from the genome. In some embodiments, one or more AarI sites are deleted from the viral genome. In some embodiments, one or more BsaI sites are deleted from the viral genome. In some embodiments, one or more restriction sites are completely eliminated from the genome (e.g., all the AarI sites in the viral genome may be eliminated). In some embodiments, one or more AvaI restriction sites are introduced into the viral genome. In some embodiments, one or more Stu sites are introduced into the viral genome. In some embodiments, the one or more modifications may include the incorporation of recombineering targets including but not limited to loxP or FRT sites.

In some embodiments, the modifications may include the introduction of fluorescence markers such as but not limited to green fluorescent protein (GFP), enhanced GFP, yellow fluorescent protein (YFP), cyan/blue fluorescent protein (BFP), red fluorescent protein (RFP), or variants thereof, etc.; selectable markers such as but not limited to drug resistance markers (e.g., *E. coli* xanthine-guanine phosphoribosyl transferase gene (gpt), *Streptomyces alboniger* puromycin acetyltransferase gene (pac), neomycin phosphotransferase I gene (npt1), neomycin phosphotransferase gene II (nptII), hygromycin phosphotransferase (hpt), sh ble gene, etc.; protein or peptide tags such as but not limited to MBP (maltose-binding protein), CBD (cellulose-binding domain), GST (glutathione-S-transferase), poly(His), FLAG, V5, c-Myc, HA (hemagglutinin), NE-tag, CAT (chloramphenicol acetyl transferase), DHFR (dihydrofolate reductase), HSV (Herpes simplex virus), VSV-G (Vesicular stomatitis virus glycoprotein), luciferase, protein A, protein G, streptavidin, T7, thioredoxin, Yeast 2-hybrid tags such as B42, GAL4, LexA, or VP16; localization tags such as an NLS-tag, SNAP-tag, Myr-tag, etc. It is understood that other selectable markers and/or tags known in the art may be used. In some embodiments, the modifications include one or more selectable markers to aid in the selection of reactivated clones (e.g., a fluorescence marker such as YFP, a drug selection marker such as gpt, etc.) to aid in the selection of reactivated viral clones. In some embodiments, the one or more selectable markers are deleted from the reactivated clones after the selection step.

The scPVs of the invention can be used as vaccines to protect against pathogenic poxviral infections (e.g., VARV, MPXV, MCV, ORFV, Ausdyk virus, BPSV, sealpox virus etc.), as therapeutic agents to treat or prevent pathogenic poxviral infections (e.g., VARV, MPXV, MCV, ORFV, Ausdyk virus, BPSV, sealpox virus etc.), as vehicles for heterologous gene expression, or as oncolytic agents. In some embodiments, the scPVs of the invention can be used as vaccines to protect against VARV infection. In some embodiments, the scPVs of the invention can be used to treat or prevent VARV infection.

Methods of Producing Synthetic Chimeric Poxviruses

The invention provides systems and methods for synthesizing, reactivating and isolating functional synthetic chimeric poxviruses (scPVs) from chemically synthesized overlapping double-stranded DNA fragments of the viral genome. Recombination of overlapping DNA fragments of the viral genome and reactivation of the functional scPV are carried out in cells previously infected with a helper virus. Briefly, overlapping DNA fragments that encompass all or substantially all of the viral genome of the scPV are chemically synthesized and transfected into helper virus-infected cells. The transfected cells are cultured to produce mixed viral progeny comprising the helper virus and reactivated scPV. Next, the mixed viral progeny are plated on host cells that do not support the growth of the helper virus but allow the synthetic chimeric poxvirus to grow, in order to eliminate the helper virus and recover the synthetic chimeric poxvirus. In some embodiments, the helper virus does not infect the host cells. In some embodiments, the helper virus can infect the host cells but grows poorly in the host cells. In some embodiments, the helper virus grows more slowly in the host cells compared to the scPV.

In some embodiments, substantially all of the synthetic chimeric poxviral genome is derived from chemically synthesized DNA. In some embodiments, about 40%, about 50%, about 60%, about 70%, about 75%, about 80%, about 85%, about 90%, about 95%, about 96%, about 97%, about 98%, about 99%, over 99%, or 100% of the synthetic chimeric poxviral genome is derived from chemically synthesized DNA. In some embodiments, the poxviral genome is derived from a combination of chemically synthesized DNA and naturally occurring DNA.

The number of overlapping DNA fragments used in the methods of the invention will depend on the size of the poxviral genome. Practical considerations such as reduction in recombination efficiency as the number of fragments increases on the one hand, and difficulties in synthesizing very large DNA fragments as the number of fragments decreases on the other hand, will also inform the number of overlapping fragments used in the methods of the invention. In some embodiments, the synthetic chimeric poxviral genome may be synthesized as a single fragment. In some embodiments, the synthetic chimeric poxviral genome is assembled from 2-14 overlapping DNA fragments. In some embodiments, the synthetic chimeric poxviral genome is assembled from 4-12 overlapping DNA fragments. In some embodiments, the synthetic chimeric poxviral genome is assembled from 6-10 overlapping DNA fragments. In some embodiments, the synthetic chimeric poxviral genome is assembled from 8-12 overlapping DNA fragments. In some embodiments, the synthetic chimeric poxviral genome is assembled from 8-10, 10-12, or 10-14 overlapping DNA fragments. In some embodiments, the synthetic chimeric poxviral genome is assembled from 2, 3, 4, 5, 6, 7, 8, 9, 10, 11, 12, 13, 14, or 15 overlapping DNA fragments. In some embodiments, the synthetic chimeric poxviral genome is assembled from 10 overlapping DNA fragments. In an exemplary embodiment of the disclosure, a synthetic chimeric horsepox virus (scHPXV) is reactivated from 10 chemically synthesized overlapping double-stranded DNA fragments. In some embodiments, terminal hairpin loops are synthesized separately and ligated onto the fragments comprising the left and right ends of the poxviral genome. In some embodiments, terminal hairpin loops may be derived from a naturally occurring template. In some embodiments, the terminal hairpins of an scPV of the invention are derived from VACV. In some embodiments, the terminal hairpins are derived from CMLV, CPXV, ECTV, HPXV, MPXV, RPXV, raccoonpox virus, skunkpox virus, Taterapox virus, Uasin Gishu disease virus or VPV. In some embodiments, the terminal hairpins are based on the terminal hairpins of any poxvirus whose genome has been completely sequenced or a natural isolate of which is available for genome sequencing. In some embodiments, all of the fragments encompassing the poxviral genome are chemically synthesized. In some embodiments, one or more of the fragments are chemically synthesized and one or more of the fragments are derived from naturally occurring DNA (e.g., by PCR amplification or by well-established recombinant DNA techniques).

The size of the overlapping fragments used in the methods of the invention will depend on the size of the poxviral genome. It is understood that there can be wide variations in fragment sizes and various practical considerations, such as the ability to chemically synthesize very large DNA fragments, will inform the choice of fragment sizes. In some embodiments, the fragments range in size from about 2,000 bp to about 50,000 bp. In some embodiments, the fragments range in size from about 3,000 bp to about 45,000 bp. In some embodiments, the fragments range in size from about 4,000 bp to 40,000 bp. In some embodiments, the fragments range in size from about 5,000 bp to 35,000 bp. In some embodiments, the largest fragments are about 20,000 bp, 21,000 bp, 22,000 bp, 23,000 bp, 24,000 bp, 25,000 bp, 26,000 bp, 27,000 bp, 28,000 bp, 29,000 bp, 30,000 bp, 31,000 bp, 32,000 bp, 33,000 bp, 34,000 bp, 35,000 bp, 36,000 bp, 37,000 bp, 38,000 bp, 39,000 bp, 40,000 bp, 41,000 bp, 42,000 bp, 43,000 bp, 44,000 bp, 45,000 bp, 46,000 bp, 47,000 bp, 48,000 bp, 49,000 bp, or 50,000 bp. In an exemplary embodiment of the disclosure, an scHPXV is reactivated from 10 chemically synthesized overlapping double-stranded DNA fragments ranging in size from about 8,500 bp to about 32,000 bp (Table 1).

The helper virus may be any poxvirus that can provide the trans-acting enzymatic machinery needed to reactivate a poxvirus from transfected DNA. The helper virus may have a different or narrower host cell range than an scPV to be produced (e.g., Shope fibroma virus (SFV) has a very narrow host range compared to Orthopoxviruses such as vaccinia virus (VACV) or HPXV). The helper virus may have a different plaque phenotype compared to the scPV to be produced. In some embodiments, the helper virus is a Leporipoxvirus. In some embodiments, the Leporipoxvirus is an SFV, hare fibroma virus, rabbit fibroma virus, squirrel fibroma virus, or myxoma virus. In some embodiments, the helper virus is an SFV. In some embodiments, the helper virus is an Orthopoxvirus. In some embodiments, the Orthopoxvirus is a camelpox virus (CMLV), cowpox virus (CPXV), ectromelia virus (ECTV, "mousepox agent"), HPXV, monkeypox virus (MPXV), rabbitpox virus (RPXV), raccoonpox virus, skunkpox virus, Taterapox virus, Uasin Gishu disease virus, VACV and volepox virus (VPV). In some embodiments, the helper virus is an Avipoxvirus, Capripoxvirus, Cervidpoxvirus, Crocodylipoxvirus, Molluscipoxvirus, Parapoxvirus, Suipoxvirus, or Yatapoxvirus. In some embodiments, the helper virus is a fowlpox virus. In some embodiments, the helper virus is an Alphaentomopoxvirus, Betaentomopoxvirus, or Gammaentomopoxvirus. In some embodiments, the helper virus is a psoralen-inactivated helper virus. In an exemplary embodiment of the disclosure, an scHPXV is reactivated from overlapping DNA fragments transfected into SFV-infected BGMK cells. The SFV is then eliminated by plating the mixed viral progeny on BSC-40 cells.

The skilled worker will understand that appropriate host cells to be used for the reactivation of the scPV and the selection and/or isolation of the scPV will depend on the particular combination of helper virus and chimeric poxvirus being produced by the methods of the invention. Any host cell that supports the growth of both the helper virus and the scPV may be used for the reactivation step and any host cell that does not support the growth of the helper virus may be used to eliminate the helper virus and select and/or isolate the scPV. In some embodiments, the helper virus is a Leporipoxvirus and the host cells used for the reactivation step may be selected from rabbit kidney cells (e.g., LLC-RK1, RK13, etc.), rabbit lung cells (e.g., R9ab), rabbit skin cells (e.g., SF1Ep, DRS, RAB-9), rabbit cornea cells (e.g., SIRC), rabbit carcinoma cells (e.g., Oc4T/cc), rabbit skin/carcinoma cells (e.g., CTPS), monkey cells (e.g., Vero, BGMK, etc.) or hamster cells (e.g., BHK-21, etc.). In some embodiments, the helper virus is SFV.

The scPVs of the present invention can be propagated in any substrate that allows the virus to grow to titers that permit the uses of the scPVs described herein. In one embodiment, the substrate allows the scPVs to grow to titers comparable to those determined for the corresponding wild-type viruses. The scPVs of the invention may be grown in cells (e.g., avian cells, bat cells, bovine cells, camel cells, canary cells, cat cells, deer cells, equine cells, fowl cells, gerbil cells, goat cells, human cells, monkey cells, pig cells, rabbit cells, raccoon cells, seal cells, sheep cells, skunk cells, vole cells, etc.) that are susceptible to infection by the poxviruses. Such methods are well-known to those skilled in the art. Representative mammalian cells include, but are not limited to BHK, BGMK, BRL3A, BSC-40, CEF, CEK, CHO, COS, CVI, HaCaT, HEL, HeLa cells, HEK293, human bone osteosarcoma cell line 143B, MDCK, NIH/3T3, Vero cells, etc.). For virus isolation, the scPV is removed from cell culture and separated from cellular components, typically by well known clarification procedures, e.g., such as gradient centrifugation and column chromatography, and may be further purified as desired using procedures well known to those skilled in the art, e.g., plaque assays.

Polynucleotides of the Invention

The invention provides polynucleotides (e.g., double-stranded DNA fragments) for producing functional synthetic chimeric poxviruses (scPVs). The invention provides methods for producing functional scPVs from synthetic DNA (e.g., chemically synthesized DNA, PCR amplified DNA, engineered DNA, polynucleotides comprising nucleoside analogs, etc.). In some embodiments, the invention provides methods for producing functional scPVs from chemically synthesized overlapping double-stranded DNA fragments of the viral genome. The polynucleotides of the invention may be designed based on publicly available genome sequences. Where natural isolates of a poxvirus are readily available, the viral genome may be sequenced prior to selecting and designing the polynucleotides of the invention. Alternatively, where partial DNA sequences of a poxvirus are available, for example, from a clinical isolate, from a forensic sample or from PCR amplified DNA from material associated with an infected person, the partial viral genome may be sequenced prior to selecting and designing the polynucleotides of the invention. An scPV of the invention, and thus, the polynucleotides of the invention, may be based on the genome sequences of naturally occurring strains, variants or mutants, mutagenized viruses or genetically engineered viruses.

The invention provides isolated polynucleotides including a nucleotide sequence that is at least 90% identical (e.g., at least 91%, 92%, 93%, or 94% identical), at least 95% identical (e.g., at least 96%, 97%, 98%, or 99% identical), or 100% identical to all or a portion of a reference poxviral genome sequence or its complement. The isolated polynucleotides of the invention may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, 35000, 40000, 45000 bp or more contiguous or non-contiguous nucleotides of a reference polynucleotide molecule (e.g., a reference poxviral genome or a fragment thereof). One of ordinary skill in the art will appreciate that nucleic acid sequences complementary to the nucleic acids, and variants of the nucleic acids are also within the scope of this invention. In further embodiments, the nucleic acid sequences of the invention can be isolated, recombinant, and/or fused with a heterologous nucleotide sequence, or in a DNA library.

In some aspects, the invention provides polynucleotides for producing scPVs wherein the poxvirus is selected from the genus Avipoxvirus, Capripoxvirus, Cervidpoxvirus, Crocodylipoxvirus, Leporipoxvirus, Molluscipoxvirus, Orthopoxvirus, Parapoxvirus, Suipoxvirus, or Yatapoxvirus. In some embodiments, the poxvirus is an Orthopoxvirus. In some embodiments, the Orthopoxvirus is selected from camelpox virus (CMLV), cowpox virus (CPXV), ectromelia virus (ECTV, "mousepox agent"), HPXV, monkeypox virus (MPXV), rabbitpox virus (RPXV), raccoonpox virus, skunkpox virus, Taterapox virus, Uasin Gishu disease virus, VACV, variola virus (VARV) and volepox virus (VPV). In a preferred embodiment, the poxvirus is an HPXV. In another preferred embodiment, the poxvirus is a VACV. In another preferred embodiment, the poxvirus is the ACAM2000 clone of VACV. In another preferred embodiment, the poxvirus is the VACV strain IOC (VACV-IOC) (Genbank Accession KT184690 and KT184691). In another preferred embodiment, the scVACV genome is based on Modified Vaccinia virus Ankara (Genbank Acccession U94848; Genbank Accession AY603355). In yet another preferred embodiment, the scVACV genome is based on MVA-BN (Genbank Accession DQ983238). In some embodiments, the poxvirus is a Parapoxvirus. In some embodiments, the Parapoxvirus is selected from orf virus (ORFV), pseudocowpox virus (PCPV), bovine popular stomatitis virus (BPSV), squirrel parapoxvirus (SPPV), red deer parapoxvirus, Ausdyk virus, Chamois contagious ecythema virus, reindeer parapoxvirus, or sealpox virus. In some embodiments, the poxvirus is aMolluscipoxvirus. In some embodiments, the Molluscipoxvirus is molluscum contagiousum virus (MCV). In some embodiments, the poxvirus is a Yatapoxvirus. In some embodiments, the Yatapoxvirus is selected from Tanapox virus or Yaba monkey tumor virus (YMTV). In some embodiments, the poxvirus is a Capripoxvirus. In some embodiments, the Capripoxvirus is selected from sheepox, goatpox, or lumpy skin disease virus. In some embodiments, the poxvirus is a Suipoxvirus. In some embodiments, the Suipoxvirus is swinepox virus. In some embodiments, the poxvirus is a Leporipoxvirus. In some embodiments, the Leporipoxvirus is selected from myxoma virus, Shope fibroma virus (SFV), squirrel fibroma virus, or hare fibroma virus. New poxviruses (e.g., Orthopoxviruses) are still being constantly discovered. It is understood that an scPV of the invention may be based on such a newly discovered poxvirus.

In some aspects, the scPV is a CMLV whose genome is based on a published genome sequence (e.g., strain CMS (Genbank Accession AY009089.1)). In some aspects, the scPV is a CPXV whose genome is based on a published genome sequence (e.g., strain Brighton Red (Genbank Accession AF482758), strain GRI-90 (Genbank Accession X94355)). In some aspects, the scPV is a ECTV whose genome is based on a published genome sequence (e.g., strain Moscow (Genbank Accession NC_004105)). In some aspects, the scPV is a MPXV whose genome is based on a published genome sequence (e.g., strain Zaire-96-1-16 (Genbank Accession AF380138)). In some aspects, the scPV is a RPXV whose genome is based on a published genome sequence (e.g. strain Utrecht (Genbank Accession AY484669)). In some aspects, the scPV is a Taterapox virus whose genome is based on a published genome sequence (e.g., strain Dahomey 1968 (Genbank Accession NC_008291)).

In one aspect, the invention provides polynucleotides for producing a synthetic chimeric horsepox virus (scHPXV). In a specific embodiment, the scHPXV genome may be based on the genome sequence described for HPXV strain MNR-76 (SEQ ID NO: 49) (Tulman E R, Delhon G, Afonso C L, Lu Z, Zsak L, Sandybaev N T, et al. Genome of horsepox virus. Journal of Virology. 2006; 80(18):9244-58). This genome sequence is incomplete and appears not to include the sequence of the terminal hairpin loops. It is shown here that terminal hairpin loops from vaccinia virus (VACV) can be ligated onto the ends of the HPXV genome to produce functional scHPXV particles using the methods of the invention. The HPXV genome may be divided into 10 overlapping fragments as described in the working examples of the disclosure and shown in Table 1. In some embodiments, the genome may be divided into 2, 3, 4, 5, 6, 7, 8, 9, 10, 11, 12, 13, 14, or 15 overlapping fragments. In some embodiments, the entire genome may be provided as one fragment. The genomic locations of the exemplary overlapping fragments and fragment sizes are shown in Table 1. Table 2 shows some of the modifications that may be made in these fragments relative to the base sequence. The polynucleotides of the invention comprise nucleic acids sequences that are at least 65%, 70%, 75%, 80%, 85%, 90%, 91%, 92%, 93%, 94%, 95%, 96%, 97%, 98%, 99%, or 100% identical to SEQ ID NOs: 1-10. In some embodiments, an isolated polynucleotide of the invention comprises a variant of these sequences, wherein such variants can include missense mutations, nonsense mutations, duplications, deletions, and/or additions. SEQ ID NO: 11 and SEQ ID NO: 12 depict the nucleotide sequences of VACV (WR strain) terminal hairpin loops. In some embodiments, the terminal hairpin loops comprise nucleic acid sequences that are at least 70%, 75%, 80%, 85%, 90%, 91%, 92%, 93%, 94%, 95%, 96%, 97%, 98%, 99%, or 100% identical to SEQ ID NO: 11 or SEQ ID NO: 12.

The invention provides isolated polynucleotides including a nucleotide sequence that is at least 90% identical (e.g., at least 91%, 92%, 93%, or 94% identical), at least 95% identical (e.g., at least 96%, 97%, 98%, or 99% identical), or 100% identical to all or a portion of a reference HPXV genome sequence (e.g., SEQ ID NO: 49). In some embodiments, an isolated polynucleotide of the invention comprises a variant of the reference sequences, wherein such variants can include missense mutations, nonsense mutations, duplications, deletions, and/or additions. The isolated polynucleotides of the invention may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, 35000, 40000, 45000 bp or more contiguous or non-contiguous nucleotides of a reference polynucleotide molecule (e.g., a reference HPXV genome including but not limited to SEQ ID NO: 49, or a portion thereof).

In another aspect, the invention provides polynucleotides for producing a synthetic chimeric VACV (scVACV). In a specific embodiment, the scVACV genome is based on a published VACV genome. In a specific embodiment, the scVACV genome is based on strain ACAM2000; Genbank Accession AY313847). In a specific embodiment, the scVACV genome is based on VACV-IOC (Genbank Accession KT184690 and KT184691). In a specific embodiment, the scVACV genome is based on Modified Vaccinia virus Ankara (Genbank Acccession U94848; Genbank Accession AY603355). In a specific embodiment, the scVACV genome is based on MVA-BN (Genbank Accession DQ983238). The VACV genome may be divided into 2, 3, 4, 5, 6, 7, 8, 9, 10, 11, 12, 13, 14, or 15 overlapping fragments. In some embodiments, the entire genome may be provided as one fragment. In a specific embodiment, the VACV genome is divided into the nine overlapping fragments as shown in Table 7. The polynucleotides of the invention comprise nucleic acids sequences that are at least 65%, 70%, 75%, 80%, 85%, 90%, 91%, 92%, 93%, 94%, 95%, 96%, 97%, 98%, 99%, or 100% identical to SEQ ID NOs: 50-58. In some embodiments, an isolated polynucleotide of the invention comprises a variant of these sequences, wherein such variants can include missense mutations, nonsense mutations, duplications, deletions, and/or additions. In other embodiments, the scVACV genome is based on a VACV strain selected from Western Reserve (Genbank Accession NC 006998; Genbank Accession AY243312), CL3 (Genbank Accession AY313848), Tian Tian (Genbank Accession AF095689.1), Tian Tian clones TT9 (JX489136), TP3 (Genbank Accession KC207810) and TP5 (Genbank Accession KC207811), NYCBH, Wyeth, Copenhagen (Genbank Accession M35027), Lister 107 (Genbank Accession DQ121394) Lister-LO (Genbank Accession AY678276), Modified Vaccinia virus Ankara (MVA) (Genbank Accession U94848; Genbank Accession AY603355), MVA-BN (Genbank Accession DQ983238), Lederle, Tashkent clones TKT3 (Genbank Accession KM044309) and TKT4 (KM044310), USSR, Evans, Praha, LIVP, Ikeda, IHD-W (Genbank Accession KJ125439), LC16m8 (AY678275), EM-63, IC, Malbran, Duke (Genbank Accession DQ439815), 3737 (Genbank Accession DQ377945), CV-1, Connaught Laboratories, CVA (Genbank Accession AM501482), Serro 2 virus (Genbank Accession KF179385), Cantaglo virus isolate CM-01 (Genbank Accession KT013210), Dryvax clones DPP15 (Genbank Accession JN654981), DPP20 (Genbank Accession JN654985), DPP13 (Genbank Accession JN654980), DPP17 (Genbank Accession JN654983), DPP21 (Genbank Accession JN654986). The VACV genome may be divided into 2, 3, 4, 5, 6, 7, 8, 9, 10, 11, 12, 13, 14, or 15 overlapping fragments. In some embodiments, the entire genome may be provided as one fragment.

The invention provides in one embodiment isolated polynucleotides including a nucleotide sequence that is at least 90% identical (e.g., at least 91%, 92%, 93%, or 94% identical), at least 95% identical (e.g., at least 96%, 97%, 98%, or 99% identical), or 100% identical to all or a portion of a reference genome sequence or its complement (e.g., VACV). In some embodiments, an isolated polynucleotide of the invention comprises a variant of the reference sequences, wherein such variants can include missense mutations, nonsense mutations, duplications, deletions, and/or additions. The isolated polynucleotides of the invention may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, 35000, 40000, 45000 bp or more contiguous or non-contiguous nucleotides of a reference genome or portion thereof.

Polynucleotides complementary to any of the polynucleotide sequences disclosed herein are also encompassed by the present invention. Polynucleotides may be single-stranded (coding or antisense) or double-stranded, and may be DNA (genomic or synthetic) or RNA molecules. RNA molecules include mRNA molecules. Additional coding or non-coding sequences may, but need not, be present within a polynucleotide of the present invention, and a polynucleotide may, but need not, be linked to other molecules and/or support materials.

Two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, or 40 to about 50, in which a sequence may be compared to a reference sequence of the same number of contiguous positions after the two sequences are optimally aligned. Polynucleotides or variants may also, or alternatively, be substantially homologous to a polynucleotide provided herein. Such polynucleotide variants are capable of hybridizing under moderately stringent conditions to a polynucleotide of the invention (or its complement).

Suitable "moderately stringent conditions" include prewashing in a solution of 5×SSC, 0.5% SDS, 1.0 mM EDTA (pH 8.0); hybridizing at 50° C.-65° C., 5×SSC, overnight; followed by washing twice at 65° C. for 20 minutes with each of 2×, 0.5× and 0.2×SSC containing 0.1% SDS.

As used herein, "highly stringent conditions" or "high stringency conditions" are those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. The skilled artisan will recognize how to adjust the temperature, ionic strength, etc. as necessary to accommodate factors such as probe length and the like.

The polynucleotides of this invention can be obtained using chemical synthesis, recombinant methods, or PCR. Methods of chemical polynucleotide synthesis are well known in the art and need not be described in detail herein. One of skill in the art can use the sequences provided herein and a commercial DNA synthesizer to produce a desired DNA sequence.

For preparing polynucleotides using recombinant methods, a polynucleotide comprising a desired sequence can be inserted into a suitable vector, and the vector in turn can be introduced into a suitable host cell for replication and amplification, as further discussed herein. Polynucleotides may be inserted into host cells by any means known in the art. Cells are transformed by introducing an exogenous polynucleotide by direct uptake, endocytosis, transfection, F-mating or electroporation. Once introduced, the exogenous polynucleotide can be maintained within the cell as a non-integrated vector (such as a plasmid) or integrated into the host cell genome. The polynucleotide so amplified can be isolated from the host cell by methods well known within the art. See, e.g., Sambrook et al., 1989.

Alternatively, PCR allows reproduction of DNA sequences. PCR technology is well known in the art and is described in U.S. Pat. Nos. 4,683,195, 4,800,159, 4,754,065 and 4,683,202, as well as PCR: The Polymerase Chain Reaction, Mullis et al. eds., Birkauswer Press, Boston, 1994.

RNA can be obtained by using the isolated DNA in an appropriate vector and inserting it into a suitable host cell. When the cell replicates and the DNA is transcribed into RNA, the RNA can then be isolated using methods well known to those of skill in the art, as set forth in Sambrook et al., 1989, supra, for example.

In other embodiments, nucleic acids of the invention also include nucleotide sequences that hybridize under highly stringent conditions to the nucleotide sequences set forth in SEQ ID NOs: 1-10, or 50-58, or sequences complementary thereto. One of ordinary skill in the art will readily understand that appropriate stringency conditions which promote DNA hybridization can be varied. For example, one could perform the hybridization at 6.0×sodium chloride/sodium citrate (SSC) at about 45° C., followed by a wash of 2.0×SSC at 50° C. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or temperature or salt concentration may be held constant while the other variable is changed. In one embodiment, the invention provides nucleic acids which hybridize under low stringency conditions of 6×SSC at room temperature followed by a wash at 2×SSC at room temperature.

Isolated nucleic acids which differ due to degeneracy in the genetic code are also within the scope of the invention. For example, a number of amino acids are designated by more than one triplet. Codons that specify the same amino acid, or synonyms (for example, CAU and CAC are synonyms for histidine) may result in "silent" mutations which do not affect the amino acid sequence of the protein. One skilled in the art will appreciate that these variations in one or more nucleotides (up to about 3-5% of the nucleotides) of the nucleic acids encoding a particular protein may exist among members of a given species due to natural allelic variation. Any and all such nucleotide variations and resulting amino acid polymorphisms are within the scope of this invention.

The present invention further provides recombinant cloning vectors and expression vectors that are useful in cloning a polynucleotide of the present invention. The present invention further provides transformed host cells comprising a polynucleotide molecule or recombinant vector of the invention, and novel strains or cell lines derived therefrom.

A host cell may be a bacterial cell, a yeast cell, a filamentous fungal cell, an algal cell, an insect cell, or a mammalian cell. In some embodiments, the host cell is *E. coli*. A variety of different vectors have been developed for specific use in each of these host cells, including phage, high copy number plasmids, low copy number plasmids, and shuttle vectors, among others, and any of these can be used to practice the present invention.

Suitable cloning vectors may be constructed according to standard techniques, or may be selected from a large number of cloning vectors available in the art. While the cloning vector selected may vary according to the host cell intended to be used, useful cloning vectors will generally have the ability to self-replicate, may possess a single target for a particular restriction endonuclease, and/or may carry genes for a marker that can be used in selecting clones containing the vector. Suitable examples include plasmids and bacterial viruses, e.g., pBAD18, pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Strategene, and Invitrogen.

To aid in the selection of host cells transformed or transfected with cloning vectors of the present invention, the vector can be engineered to further comprise a coding sequence for a reporter gene product or other selectable marker. Such a coding sequence is preferably in operative association with the regulatory element coding sequences, as described above. Reporter genes that are useful in the invention are well-known in the art and include those encoding green fluorescent protein, luciferase, xylE, and tyrosinase, among others. Nucleotide sequences encoding selectable markers are well known in the art, and include those that encode gene products conferring resistance to antibiotics or anti-metabolites, or that supply an auxotrophic requirement. Examples of such sequences include those that encode resistance to ampicillin, erythromycin, thiostrepton or kanamycin, among many others.

The vectors containing the polynucleotides of interest and/or the polynucleotides themselves, can be introduced into the host cell by any of a number of appropriate means, including electroporation, transfection employing calcium chloride, rubidium chloride, calcium phosphate, DEAE-dextran, or other substances; microprojectile bombardment; lipofection; and infection (e.g., where the vector is an infectious agent such as vaccinia virus). The choice of introducing vectors or polynucleotides will often depend on features of the host cell.

The present invention further provides transformed host cells comprising a polynucleotide molecule or recombinant vector of the invention, and novel strains or cell lines derived therefrom. In some embodiments, host cells useful in the practice of the invention are *E. coli* cells. A strain of *E. coli* can typically be used, such as e.g., *E. coli* TOP10, or *E. coli* BL21(DE3), DH5α, etc., available from the American Type Culture Collection (ATCC), 10801 University Blvd., Manassas, Va. 20110, USA and from commercial sources. In some embodiments, other prokaryotic cells or eukaryotic cells may be used. In some embodiments, the host cell is a member of a genus selected from: *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Paenibacillus, Arthrobacter, Corynebacterium, Brevibacterium, Schizosaccharomyces, Kluyveromyces, Yarrowia, Pichia, Candida, Pichia*, or *Saccharomyces*. Such transformed host cells typically include but are not limited to microorganisms, such as bacteria transformed with recombinant bacteriophage DNA, plasmid DNA or cosmid DNA vectors, or yeast transformed with recombinant vectors, among others. Preferred eukaryotic host cells include yeast cells, although mammalian cells or insect cells can also be utilized effectively. Suitable host cells include prokaryotes (such as *E. coli, B. subtillis, S. lividans*, or *C. glutamicum*) and yeast (such as *S. cerevisae, S. pombe, P. pastoris*, or *K. lactis*).

In one aspect, the invention also includes the genome of the scPV, its recombinants, or functional parts thereof. A functional part of the viral genome may be a portion of the genome that encodes a protein or portion thereof (e.g., domain, epitope, etc.), a portion that comprises regulatory elements or components of regulatory elements such as a promoter, enhancer, cis- or trans-acting elements, etc. Such viral sequences can be used to identify or isolate the virus or its recombinants, e.g., by using PCR, hybridization technologies, or by establishing ELISA assays.

Exemplary Uses

Prevention or Treatment of Pathogenic Poxviral Infections

The synthetic chimeric poxviruses (scPVs) of the invention can be used in immunization of a subject against a pathogenic poxviral infection. The scPVs of the invention can be used to prevent, manage, or treat one or more pathogenic poxviral infections in a subject. In some embodiments, the pathogenic poxvirus is an Orthopoxvirus (e.g., camelpox virus (CMLV), cowpox virus (CPXV), ectromelia virus (ECTV, "mousepox agent"), HPXV, monkeypox virus (MPXV), rabbitpox virus (RPXV), raccoonpox virus, skunkpox virus, Taterapox virus, Uasin Gishu disease virus, vaccinia virus (VACV), variola virus (VARV) and volepox virus (VPV)). In some embodiments, the pathogenic poxvirus is a Parapoxvirus (e.g., orf virus (ORFV), pseudocowpox virus (PCPV), bovine popular stomatitis virus (BPSV), squirrel parapoxvirus (SPPV), red deer parapoxvirus, Ausdyk virus, Chamois contagious ecythema virus, reindeer parapoxvirus, or sealpox virus). In some embodiments, the pathogenic poxvirus is aMolluscipoxvirus (e.g., molluscum contagiousum virus (MCV)). In some embodiments, the pathogenic poxvirus is a Yatapoxvirus (e.g., Tanapox virus or Yaba monkey tumor virus (YMTV)). In some embodiments, the pathogenic poxvirus is a Capripoxvirus (e.g., sheepox, goatpox, or lumpy skin disease virus). In some embodiments, the poxvirus is a Suipoxvirus (e.g., swinepox virus). In some embodiments, the pathogenic poxvirus is a Leporipoxvirus (e.g., myxoma virus, Shope fibroma virus (SFV), squirrel fibroma virus, or hare fibroma virus). In some embodiments, the pathogenic poxvirus is VARV. In some embodiments, the pathogenic poxvirus is MPXV. In some embodiments, the pathogenic poxvirus is MCV. In some embodiments, the pathogenic poxvirus is ORFV. In some embodiments, the pathogenic poxvirus is CPXV. The pathogenic poxvirus may be a poxvirus pseudotype or chimera. In some embodiments, the subject is a human subject. In some embodiments, the subject is an animal subject. New poxviruses (e.g., Orthopoxviruses) are still being constantly discovered. It is understood that an scPV of the invention can be used in immunization of a subject against a newly discovered pathogenic poxvirus or in the prevention, management, or treatment of an infection by a newly discovered pathogenic poxvirus.

The scPVs of the invention can be used in immunogenic formulations, e.g., vaccine formulations. The formulations may be used to prevent, manage, neutralize, treat and/or ameliorate a pathogenic poxviral infection. The immunogenic formulations may comprise either a live or inactivated scPV of the invention. The scPV can be inactivated by methods well known to those of skill in the art. Common methods use formalin and heat for inactivation. In some embodiments, the immunogenic formulation comprises a live vaccine. Production of such live immunogenic formulations may be accomplished using conventional methods involving propagation of the scPV in cell culture followed by purification. For example, the scPV can be cultured in BHK, BGMK, BRL3A, BSC-40, CEF, CEK, CHO, COS, CVI, HaCaT, HEL, HeLa cells, HEK293, human bone osteosarcoma cell line 143B, MDCK, NIH/3T3, Vero cells, etc., as can be determined by the skilled worker.

In one aspect, the scPVs of the invention can be used to prevent, manage, or treat smallpox. The scPVs of the invention (e.g., a synthetic chimeric HPXV (scHPXV) or a synthetic chimeric VACV (scVACV)) can be used as a vaccine for the prevention of smallpox in individuals or populations that have been exposed, potentially exposed, or are at risk of exposure to smallpox. The scPVs of the invention can be used to create a new national stockpile of smallpox vaccine (e.g., an scHPXV or scVACV of the invention). In some embodiments, the scPVs of the invention can be prophylactically administered to defense personnel, first responders, etc.

In one embodiment, a composition comprising a scHPXV of the invention is used as a smallpox vaccine. It is shown here that a scHPXV produced according to the methods of the invention has a small plaque phenotype. In general, a small plaque phenotype is considered to reflect attenuation. Accordingly, a scHIPXV produced according to the methods of the invention provides a safe alternative to the existing smallpox vaccines. In some embodiments, the vaccine may be safe for administration to immunosuppressed subjects (e.g., HIV patients, patients undergoing chemotherapy, patients undergoing treatment for cancer, rheumatologic disorders, or autoimmune disorders, patients who are undergoing or have received an organ or tissue transplant, patients with immune deficiencies, children, pregnant women, patients with atopic dermatitis, eczema, psoriasis, heart conditions, and patients on immunosuppressants etc.) who may suffer from severe complications from an existing smallpox vaccine and are thus contraindicated for an existing smallpox vaccine. In some embodiments the vaccine may be used in combination with one or more anti-viral treatments to suppress viral replication. In some embodiments the vaccine may be used in combination with brincidofovir treatment to suppress viral replication. In some embodiments the vaccine may be used in combination with tecovirimat/SIGA-246 treatment to suppress viral replication. In some embodiments, the vaccine may be used in combination with acyclic nucleoside phosphonates (cidofovir), oral alkoxyalkyl prodrugs of acyclic nucleoside or phosphonates (brincidofovir or CMX001). In some embodiments, the vaccine may be used in combination with Vaccinia Immune Globulin (VIG). In some embodiments the vaccine may be used in subjects who have been previously immunized with peptide or protein antigens derived from VACV, VARV or HPXV. In some embodiments the vaccine may be used in subjects who have been previously immunized with killed or inactivated VACV. In some embodiments the vaccine may be used in subjects who have been previously immunized with the replication-deficient/defective VACV virus strain, MVA (modified virus Ankara). A vaccine formulation comprising a scHIPXV of the invention may comprise either a live or inactivated scHPXV.

In one embodiment, a composition comprising a scVACV of the invention is used as a smallpox vaccine. The scVACV may be based on a VACV strain selected from ACAM2000 (Genbank Accession AY313847), Western Reserve (Genbank Accession NC 006998; Genbank Accession AY243312), CL3 (Genbank Accession AY313848), Tian Tian (Genbank Accession AF095689.1), Tian Tian clones TT9 (JX489136), TP3 (Genbank Accession KC207810) and TP5 (Genbank Accession KC207811), NYCBH, Wyeth, Copenhagen (Genbank Accession M35027), Lister 107 (Genbank Accession DQ121394) Lister-LO (Genbank Accession AY678276), Modified Vaccinia virus Ankara (MVA) (Genbank Acccession U94848; Genbank Accession AY603355), MVA-BN (Genbank Accession DQ983238), Lederle, Tashkent clones TKT3 (Genbank Accession KM044309) and TKT4 (KM044310), USSR, Evans, Praha, LIVP, Ikeda, IHD-W (Genbank Accession KJ125439), LC16m8 (AY678275), EM-63, IC, Malbran, Duke (Genbank Accession DQ439815), 3737 (Genbank Accession DQ377945), CV-1, Connaught Laboratories, CVA (Genbank Accession AM501482), Serro 2 virus (Genbank Accession KF179385), Cantaglo virus isolate CM-01 (Genbank Accession KT013210), Dryvax clones DPP15 (Genbank Accession JN654981), DPP20 (Genbank Accession JN654985), DPP13 (Genbank Accession JN654980), DPP17 (Genbank Accession JN654983), DPP21 (Genbank Accession JN654986) and IOC (Genbank Accession KT184690 and KT184691). In one embodiment, the scVACV to be used as a smallpox vaccine is based on strain ACAM2000 (Genbank Accession AY313847). In one embodiment, the scVACV to be used as a smallpox vaccine is based on strain VACV-IOC (Genbank Accession KT184690 and KT184691). In one embodiment, the scVAVC to be used as a smallpox vaccine is based on strain MVA (Genbank Acccession U94848; Genbank Accession AY603355). In one embodiment, the scVACV to be used as a smallpox vaccine is based on strain MVA-BN (Genbank Accession DQ983238). A vaccine formulation comprising a scPV of the invention may comprise either a live or inactivated scVACV.

In some embodiments, a composition comprising a scPV of the invention (e.g., a scHPXV or a scVACV) is used as a vaccine against a VACV infection, a MPXV infection or a CPXV infection.

In some embodiments, a scPV of the invention may be designed to express heterologous antigens or epitopes and can be used as vaccines against the source organisms of such antigens and/or epitopes.

The immunogenic formulations of the present invention (e.g., vaccines) comprise an effective amount of a scPV of the invention, and a pharmaceutically acceptable carrier. The term "pharmaceutically acceptable" means approved by a regulatory agency of the Federal or a state government or listed in the U.S.

Pharmacopeia or other generally recognized pharmacopeiae for use in animals, and more particularly in humans. The term "carrier" refers to a diluent, adjuvant, excipient, or vehicle with which the pharmaceutical composition (e.g., immunogenic or vaccine formulation) is administered. Saline solutions and aqueous dextrose and glycerol solutions can also be employed as liquid carriers, particularly for injectable solutions. Suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Examples of suitable pharmaceutical carriers are described in "Remington's Pharmaceutical Sciences" by E. W. Martin. The formulation should suit the mode of administration. The particular formulation may also depend on whether the scPV is live or inactivated. Purified scPVs of the invention may be lyophilized for later use or can be immediately prepared in a pharmaceutical solution. The scPVs may also be diluted in a physiologically acceptable solution such as sterile saline, with or without an adjuvant or carrier.

The immunogenic formulations (e.g., vaccines) of the invention may be administered to patients by scarification. The vaccines may also be administered by any other standard route of administration. Many methods may be used to introduce the immunogenic formulations (e.g., vaccines), these include but are not limited to intranasal, intratracheal, oral, intradermal, intramuscular, intraperitoneal, intravenous, conjunctival and subcutaneous routes. In birds, the methods may further include choanal inoculation. As an alternative to parenteral administration, the invention also encompasses routes of mass administration for agricultural purposes such as via drinking water or in a spray. Alternatively, it may be preferable to introduce an scPV of the invention via its natural route of infection. In some embodiments, the immunogenic formulations of the invention are administered as an injectable liquid, a consumable transgenic plant that expresses the vaccine, a sustained release gel or an implantable encapsulated composition, a solid implant or a nucleic acid. The immunogenic formulation may also be administered in a cream, lotion, ointment, skin patch, lozenge, or oral liquid such as a suspension, solution and emulsion (oil in water or water in oil).

In certain embodiments, an immunogenic formulation of the invention (e.g., vaccine) does not result in complete protection from an infection, but results in a lower titer or reduced number of the pathogen (e.g., pathogenic poxvirus) compared to an untreated subject. In certain embodiments, administration of the immunogenic formulations of the invention results in a 0.5 fold, 1 fold, 2 fold, 4 fold, 6 fold, 8 fold, 10 fold, 15 fold, 20 fold, 25 fold, 50 fold, 75 fold, 100 fold, 125 fold, 150 fold, 175 fold, 200 fold, 300 fold, 400 fold, 500 fold, 750 fold, or 1,000 fold or greater reduction in titer of the pathogen relative to an untreated subject. Benefits of a reduction in the titer, number or total burden of pathogen include, but are not limited to, less severity of symptoms of the infection and a reduction in the length of the disease or condition associated with the infection.

In certain embodiments, an immunogenic formulation of the invention (e.g., vaccine) does not result in complete protection from an infection, but results in a lower number of symptoms or a decreased intensity of symptoms, or a decreased morbidity or a decreased mortality compared to an untreated subject.

In various embodiments, the immunogenic formulations of the invention (e.g., vaccines) or antibodies generated by the scPVs of the invention are administered to a subject in combination with one or more other therapies (e.g., antiviral or immunomodulatory therapies) for the prevention of an infection (e.g., a pathogenic poxviral infection). In other embodiments, the immunogenic formulations of the invention or antibodies generated by the scPVs of the invention are administered to a subject in combination with one or more other therapies (e.g., antiviral or immunomodulatory therapies) for the treatment of an infection (e.g., a pathogenic poxviral infection). In yet other embodiments, the immunogenic formulations of the invention or antibodies generated by the scPVs of the invention are administered to a subject in combination with one or more other therapies (e.g., antiviral or immunomodulatory therapies) for the management and/or amelioration of an infection (e.g., a pathogenic poxviral infection). In a specific embodiment, the immunogenic formulations of the invention or antibodies generated by the scPVs of the invention are administered to a subject in combination with one or more other therapies (e.g., antiviral or immunomodulatory therapies) for the prevention of smallpox. In another specific embodiment, the immunogenic formulations of the invention or antibodies generated by the scPVs of the invention are administered to a subject in combination with one or more other therapies (e.g., antiviral or immunomodulatory therapies) for the treatment of smallpox. In some embodiments the vaccine may be used in combination with one or more anti-viral treatments to suppress viral replication. In some embodiments the vaccine may be used in combination with brincidofovir treatment to suppress viral replication. In some embodiments the vaccine may be used in combination with tecovirimat/SIGA-246 treatment to suppress viral replication. In some embodiments, the vaccine may be used in combination with acyclic nucleoside phosphonates (cidofovir), oral alkoxyalkyl prodrugs of acyclic nucleoside or phosphonates (brincidofovir or CMX001). In some embodiments, the vaccine may be used in combination with Vaccinia Immune Globulin (VIG). In some embodiments the vaccine may be used in subjects who have been previously immunized with peptide or protein antigens derived from VACV, VARV or HPXV. In some embodiments the vaccine may be used in subjects who have been previously immunized with killed or inactivated VACV. In some embodiments the vaccine may be used in subjects who have been previously immunized with the replication-deficient/defective VACV virus strain, MVA (modified virus Ankara).

Any anti-viral agent well-known to one of skill in the art can be used in the formulations (e.g., vaccine formulations) and the methods of the invention. Non-limiting examples of anti-viral agents include proteins, polypeptides, peptides, fusion proteins antibodies, nucleic acid molecules, organic molecules, inorganic molecules, and small molecules that inhibit and/or reduce the attachment of a virus to its receptor, the internalization of a virus into a cell, the replication of a virus, or release of virus from a cell. In particular, anti-viral agents include but are not limited to antivirals that blocks extracellular virus maturation (tecovirimat/SIGA-246), acyclic nucleoside phosphonates (cidofovir), oral alkoxyalkyl prodrugs of acyclic nucleoside phosphonates (brincidofovir or CMX001) or Vaccinia Immune Globulin (VIG). In some embodiments, anti-viral agents include, but are not limited to, nucleoside analogs (e.g., zidovudine, acyclovir, gangcyclovir, vidarabine, idoxuridine, trifluridine, and ribavirin), foscarnet, amantadine, rimantadine, saquinavir, indinavir, ritonavir, alpha-interferons and other interferons, and AZT.

Doses and dosing regimens can be determined by one of skill in the art according to the needs of a subject to be treated. The skilled worker may take into consideration factors such as the age or weight of the subject, the severity of the disease or condition being treated, and the response of the subject to treatment. A composition of the invention can be administered, for example, as needed or on a daily basis. Dosing may take place over varying time periods. For example, a dosing regimen may last for 1 week, 2 weeks, 3 weeks, 4 weeks, 5 weeks, 6 weeks, 7 weeks, 8 weeks, 9 weeks, 10 weeks, 11 weeks, 12 weeks, or longer. In some embodiments, a dosing regimen will last 1 month, 2 months, 3 months, 4 months, 5 months, 6 months, 7 months, 8 months, 9 months, 10 months, 11 months, 12 months, or longer.

The scPVs of the invention can also be used to produce antibodies useful for passive immunotherapy, diagnostic or prognostic immunoassays, etc. Methods of producing antibodies are well-known in the art. The antibodies may be further modified (e.g., chimerization, humanization, etc.) prior to use in immunotherapy.

Oncolytic Agents

The synthetic chimeric poxviruses (scPVs) of the invention can be used as oncolytic agents that selectively replicate in and kill cancer cells. Cells that are dividing rapidly, such as cancer cells, are generally more permissive for poxviral infection than non-dividing cells. Many features of poxviruses, such as safety in humans, ease of production of high-titer stocks, stability of viral preparations, and capacity to induce antitumor immunity following replication in tumor cells make poxviruses desirable oncolytic agents. The scPVs produced according to the methods of the invention may comprise one or modifications that render them suitable for the treatment of cancer. Accordingly, in one aspect, the disclosure provides a method of inducing death in cancer cells, the method comprising contacting the cells with an isolated scPV or pharmaceutical composition comprising an scPV of the invention. In one aspect, the disclosure provides a method of treating cancer, the method comprising administering to a patient in need thereof, a therapeutically effective amount of an scPV of the invention. Another aspect includes the use of an scPV or a composition described herein to induce death in a neoplastic disorder cell such as a cancer cell or to treat a neoplastic disorder such as cancer. In some embodiments, the poxvirus oncolytic therapy is administered in combination with one or more conventional cancer therapies (e.g., surgery, chemotherapy, radiotherapy, thermotherapy, and biological/immunological therapy). In specific embodiments, the oncolytic virus is a synthetic chimeric VACV (scVACV ) of this invention. In some embodiments, the oncotyic virus is a synthetic chimeric myxoma virus of this invention. In some embodiments, the oncolytic virus is a synthetic chimeric HPXV (scHPXV) of this invention. In some embodiments, the oncolytic virus is a synthetic chimeric raccoonpox virus of this invention. In some embodiments, the oncolytic virus is a synthetic chimeric yaba-like disease virus of this invention.

Using the methods of this invention, one or more desirable genes can be easily introduced and one or more undesirable genes can be easily deleted from the synthetic chimeric poxviral genome. In some embodiments, the scPVs of the invention for use as oncolytic agents are designed to express transgenes to enhance their immunoreactivity, antitumor targeting and/or potency, cell-to-cell spread and/or cancer specificity. In some embodiments, an scPV of the invention is designed or engineered to express an immunomodulatory gene (e.g., GM-CSF, or a viral gene that blocks TNF function). In some embodiments, an scPV of the invention is designed to include a gene that expresses a factor that attenuates virulence. In some embodiments, an scPV of the invention is designed or engineered to express a therapeutic agent (e.g., hEPO, BMP-4, antibodies to specific tumor antigens or portions thereof, etc.). In some embodiments, the scPVs of the invention have been modified for attenuation. In some embodiments, the scPV of the invention is designed or engineered to lack the viral TK gene. In some embodiments, an scVACV of the invention is designed or engineered to lack vaccinia growth factor gene. In some embodiments, an scVACV of the invention is designed or engineered to lack the hemagglutinin gene.

The scPVs of the invention are useful for treating a variety of neoplastic disorders and/or cancers. In some embodiments, the type of cancer includes but is not limited to bone cancer, breast cancer, bladder cancer, cervical cancer, colorectal cancer, esophageal cancer, gliomas, gastric cancer, gastrointestinal cancer, head and neck cancer, hepatic cancer such as hepatocellular carcinoma, leukemia, lung cancer, lymphomas, ovarian cancer, pancreatic cancer, prostate cancer, renal cancer, skin cancer such as melanoma, testicular cancer, etc. or any other tumors or pre-neoplastic lesions that may be treated.

In another embodiment, the method further comprises detecting the presence of the administered scPV, in the neoplastic disorder or cancer cell and/or in a sample from a subject administered an isolated or recombinant virus or composition described herein. For example, the subject can be tested prior to administration and/or following administration of the scPV or composition described herein to assess for example the progression of the infection. In some embodiments, an scPV of the disclosure comprises a detection cassette and detecting the presence of the administered chimeric poxvirus comprises detecting the detection cassette encoded protein. For example, wherein the detection cassette encodes a fluorescent protein, the subject or sample is imaged using a method for visualizing fluorescence.

The oncolytic formulations of the present invention comprise an effective amount of an scPV of the invention, and a pharmaceutically acceptable carrier. The term "pharmaceutically acceptable" means approved by a regulatory agency of the Federal or a state government or listed in the U.S. Pharmacopeia or other generally recognized pharmacopeiae for use in animals, and more particularly in humans. The term "carrier" refers to a diluent, adjuvant, excipient, or vehicle with which the pharmaceutical composition (e.g., oncolytic formulation) is administered. Saline solutions and aqueous dextrose and glycerol solutions can also be employed as liquid carriers, particularly for injectable solutions. Suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Examples of suitable pharmaceutical carriers are described in "Remington's Pharmaceutical Sciences" by E. W. Martin. The formulation should suit the mode of administration.

Viral Vectors for Recombinant Gene Expression

The synthetic chimeric poxviruses (scPVs) of the invention may be engineered to carry heterologous sequences. The heterologous sequences may be from a different poxvirus species or from any non-poxviral source. In one aspect, the heterologous sequences are antigenic epitopes that are selected from any non-poxviral source. In some embodiments, the recombinant virus may express one or more antigenic epitopes from a non-poxviral source including but not limited to *Plasmodium falciparum*, mycobacteria, *Bacillus anthracis, Vibrio cholerae*, MIRSA, rhabdovirus, influenza virus, viruses of the family of flaviviruses, paramyxoviruses, hepatitis viruses, human immunodeficiency viruses, or from viruses causing hemorrhagic fever, such as hantaviruses or filoviruses, i.e., ebola or marburg virus. In another aspect, the heterologous sequences are antigenic epitopes from a different poxvirus species. These viral sequences can be used to modify the host spectrum or the immunogenicity of the scPV.

In some embodiments, an scPV of the invention may code for a heterologous gene/nucleic acid expressing a therapeutic nucleic acid (e.g., antisense nucleic acid) or a therapeutic peptide (e.g., peptide or protein with a desired biological activity).

In some embodiments, the expression of a heterologous nucleic acid sequence is preferably, but not exclusively, under the transcriptional control of a poxvirus promoter. In some embodiments, the heterologous nucleic acid sequence is preferably inserted into a non-essential region of the virus genome. Methods for inserting heterologous sequences into the poxviral genome are known to a person skilled in the art. In some embodiments, the heterologous nucleic acid is introduced by chemical synthesis. In an exemplary embodiment, a heterologous nucleic acid may be cloned into the HPXVO95/J2R or HPXV044 locus of an scHPXV of the invention.

An scPV of the present invention may be used for the introduction of a heterologous nucleic acid sequence into a target cell, the sequence being either homologous or heterologous to the target cell. The introduction of a heterologous nucleic acid sequence into a target cell may be used to produce in vitro heterologous peptides or polypeptides, and/or complete viruses encoded by the sequence. This method comprises the infection of a host cell with the scPV; cultivation of the infected host cell under suitable conditions; and isolation and/or enrichment of the peptide, protein and/or virus produced by the host cell.

It is to be understood that the embodiments of the present invention which have been described are merely illustrative of some of the applications of the principles of the present invention. Numerous modifications may be made by those skilled in the art based upon the teachings presented herein without departing from the true spirit and scope of the invention.

The following examples are set forth as being representative of the present invention. These examples are not to be construed as limiting the scope of the invention as these and other equivalent embodiments will be apparent in view of the present disclosure, figures, and accompanying embodiments.

EXAMPLES

Example 1. Selection and Design of Overlapping Fragments of the Viral Genome

Materials and Methods
Synthetic Chimeric HPXV (scHPXV) Genome Design

Design of the scHPXV genome is based on the previously described genome sequence for HPXV (strain MNR-76; FIG. 1A) [GenBank accession DQ792504](Tulman E R, Delhon G, Afonso C L, Lu Z, Zsak L, Sandybaev N T, et al. Genome of horsepox virus. Journal of Virology. 2006; 80(18):9244-58). The 212,633 bp genome is divided into 10 overlapping fragments (FIG. 1B). These fragments were designed so that they shared at least 1.0 kbp of overlapping sequence (i.e. homology) with each adjacent fragment, to provide sites where homologous recombination will drive the assembly of full-length genomes (Table 1). These overlapping sequences will provide sufficient homology to accurately carry out recombination between the co-transfected fragments (Yao X D, Evans D H. High-frequency genetic recombination and reactivation of orthopoxviruses from DNA fragments transfected into leporipoxvirus-infected cells. Journal of Virology. 2003; 77(13):7281-90). It is possible that shorter or longer overlaps will serve a similar purpose. The terminal 40 bp from the HPXV genome sequence (5'-TTTATTAAATTTTACTATTTATTTAGTGTCTAGAAAAAAA-3') (SEQ ID NO: 59) is not included in the synthesized inverted terminal repeat (ITR) fragments. Instead, a SapI restriction site is added at the 5'-terminus (GA_LITR) and 3'-terminus (GA_RITR) of the ITR fragments followed by a TGT sequence. These SapI restriction sites are used to ligate the VACV terminal hairpins onto the ITR fragments (described below).

Each fragment is chemically synthesized and subcloned into a plasmid using terminal SfiI restriction sites on each fragment. To assist with sub-cloning these fragments, AarI and BsaI restriction sites are silently mutated in all the fragments, except for the two ITR-encoding fragments (Table 2). The BsaI restriction sites in the two ITR-encoding fragments are not mutated, in case these regions contain nucleotide sequence-specific recognition sites that are important for efficient DNA replication and concatamer resolution.

Figure 10A:
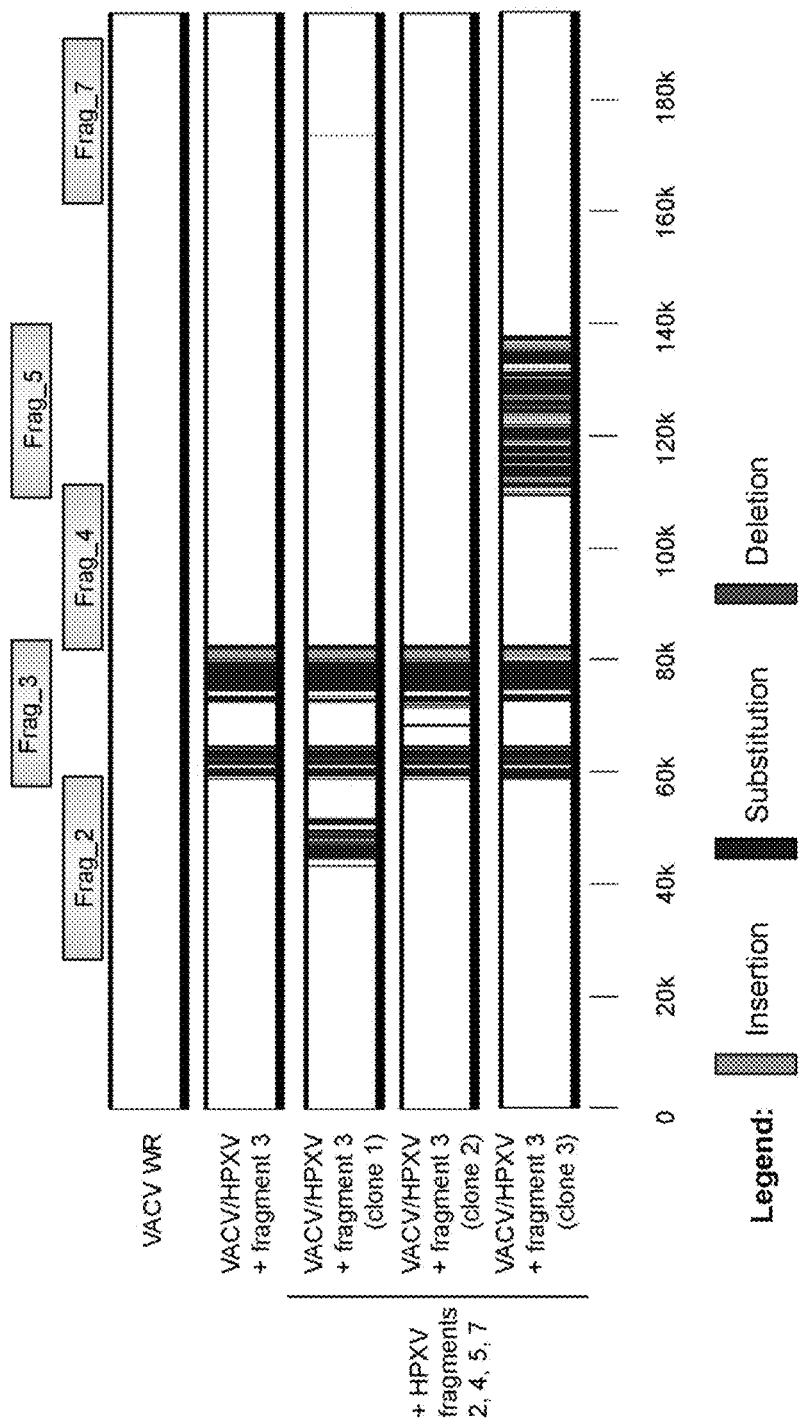
FIGS. 10A and 10B. Characterization of VACV-HPXV hybrid viruses. A. HPXV inserts in VACV strain WR. Virus genomes were sequenced using an ILLUMINA© platform, assembled, and LAGAN[32] and "Base-by-Base"[33] software were used to align and generate the maps shown. Places where VACV sequences (white) have been replaced by HPXV sequences are color coded according to the difference. The first hybrid virus ("VACV/HPXV+fragment 3") was obtained by co-transfecting VACV DNA with HPXV Fragment_3 into SFV-infected cells. The green-tagged insertion encodes the YFP-gpt selection marker. Clones 1-3 were obtained by purifying the DNA from this first hybrid genome and transfecting it again, along with HPXV fragments 2, 4, 5, and 7, into SFV-infected cells. B. A PCR-based screening approach for identifying hybrid and reactivated viruses. PCR primers designed to target both HPXV and VACV and used to amplify DNA segments spanning the BsaI sites that were mutated in the synthetic HPXV clones. Following PCR amplification, the products were digested with BsaI to differentiate VACV sequences (which cut) from HPXV (which do not cut). The VACV/HPXV hybrids exhibit a mix of BsaI sensitive and resistant sites whereas the reactivated scHPXV YFP-gpt::095 clone is fully BsaI resistant.
Figure 10B:
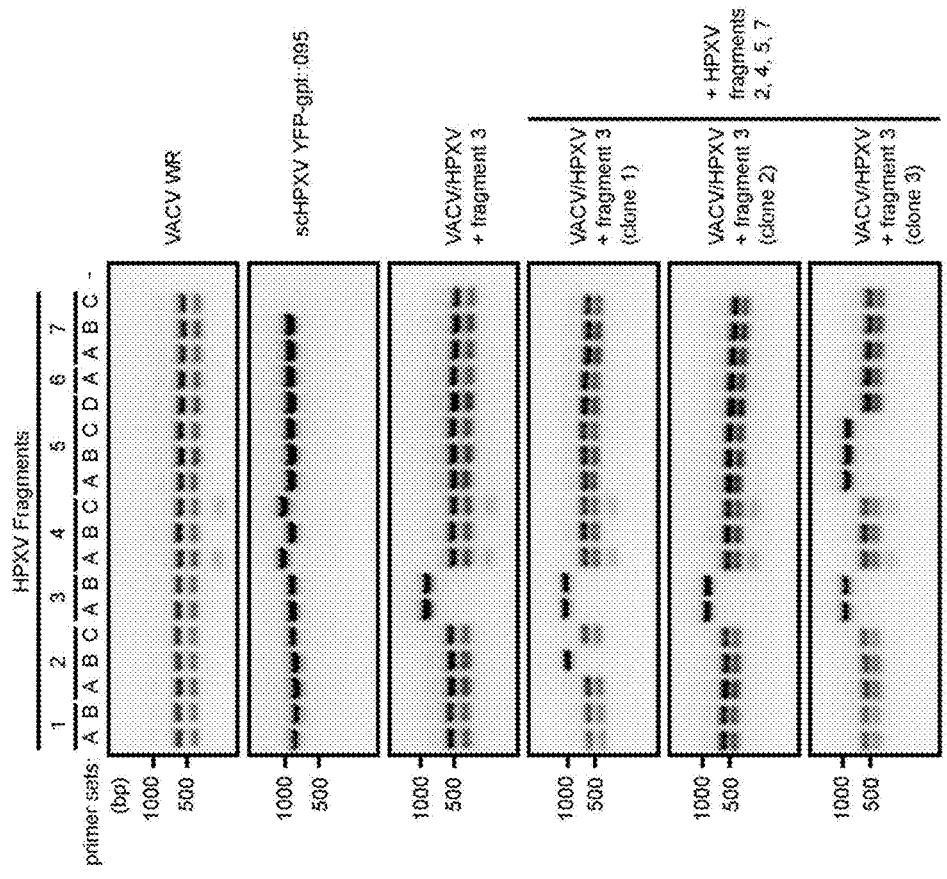

A yfp/gpt cassette under the control of a poxvirus early late promoter is introduced into the HPXVO95/J2R locus within GA_Fragment_3) so that reactivation of HPXV (scHPXV YFP-gpt::095) will be easy to visualize under a fluorescence microscope. The gpt locus also provides a potential tool for selecting reactivated viruses using drug selection. HPXV095 encodes the HPXV homolog of the non-essential VACV J2R gene and by co-transfecting Fragment_3 and other HPXV clones into SFV-infected BGMK cells, along with VACV DNA, a variety of hybrid viruses are recovered, validating the selection strategy (FIGS. 10A and 10B). Silent mutations are also introduced into the HPXV044 (VACV$^{WR}$F4L) sequence (GA_Fragment_2) to create two unique restrictions sites within GA_Fragment_2 (Table 3). In some embodiments, these unique restriction sites may be used to rapidly introduce recombinant gene products (such as but not limited to, selectable markers, fluorescent proteins, antigens, etc.) into GA_Fragment_2 prior to reactivation of HPXV.

TABLE 1

The HPXV genome fragments used in this study. The size of each fragment and location within the HPXV genome are indicated.

| Fragment Name | Size (bp) | Location within HPXV [DQ792504] (bp) |
|---|---|---|
| GA_Left ITR (SEQ ID NO: 1) | 10,095 | 41-10,135 |
| GA_Fragment 1A (SEQ ID NO: 2) | 16,257 | 8505-24,761 |

TABLE 1-continued

The HPXV genome fragments used in this study. The size of each fragment and location within the HPXV genome are indicated.

| Fragment Name | Size (bp) | Location within HPXV [DQ792504] (bp) |
|---|---|---|
| GA_Fragment 1B (SEQ ID NO: 3) | 16,287 | 23764-40,050 |
| GA_Fragment 2 (SEQ ID NO: 4) | 31,946 | 38,705-70,650 |
| GA_Fragment 3 (SEQ ID NO: 5) | 25,566 | 68,608-94,173 |
| GA_Fragment 4 (SEQ ID NO: 6) | 28,662 | 92,587-121,248 |
| GA_Fragment 5 (SEQ ID NO: 7) | 30,252 | 119,577-149,828 |
| GA_Fragment 6 (SEQ ID NO: 8) | 30,000 | 147,651-177,650 |
| GA_Fragment 7 (SEQ ID NO: 9) | 28,754 | 176,412-205,165 |
| GA_Right ITR (SEQ ID NO: 10) | 8,484 | 204,110-212,593 |

TABLE 2

Silent mutations created in scHPXV YFP-gpt::095 fragments to remove AarI and BsaI restriction sites from HPXV genome.

| GA_HPXV Fragment | Restriction endonuclease recognition site removed | Nucleotide change in coding strand of HPXV genome | HPXV Gene | Location in HPXV genome [DQ792504] | Mutation verified by whole genome sequencing |
|---|---|---|---|---|---|
| GA_Frag_1A | BsaI | A to G | HPXV011a | 11,228 | ✓ |
| GA_Frag_1B | BsaI | A to G | HPXV025 | 27,845 | ✓ |
| GA_Frag_2 | BsaI | A to G | HPXV040 | 41,232 | ✓ |
| | BsaI | G to A | HPXV059 | 56,775 | ✓ |
| | BsaI | G to A | HPXV066 | 67,836 | ✓ |
| GA_Frag_3 | BsaI | G to A | HPXV083 | 84,361 | ✓ |
| | AarI | T to C | HPXV091 | 89,368 | ✓ |
| GA_Frag_4 | BsaI | T to C | HPXV099 | 96,239 | ✓ |
| | BsaI | A to G | HPXV099 | 96,437 | ✓ |
| | BsaI | A to G | HPXV110 | 109,492 | ✓ |
| | BsaI | A to G | HPXV111 | 110,661 | ✓ |
| | BsaI | G to A | HPXV111 | 110,840 | ✓ |
| GA_Frag_4 GA_Frag_5 | BsaI | C to T | HPXV119 | 120,933 | ✓ |
| GA_Frag_5 | BsaI | A to G | HPXV123 | 123,035 | ✓ |
| | BsaI | T to C | HPXV145 | 144,834 | ✓ |
| GA_Frag_5 GA_Frag_6 | BsaI | T to C | HPXV146d | 149,727 | ✓ |
| GA_Frag_6 | BsaI | G to A | HPXV178b | 175,070 | ✓ |
| GA_Frag_7 | BsaI | G to A | HPXV182 | 180,573 | ✓ |
| | BsaI | A to G | HPXV192 | 187,476 | ✓ |
| | AarI | G to A | HPXV193 | 188,761 | ✓ |
| | BsaI | C to T | HPXV197 | 195,680 | ✓ |
| | AarI | T to C | HPXV200 | 199,873 | ✓ |

TABLE 3

Introduction of silent nucleotide mutations in the HPXV044 (VACV F4L) gene to create unique restriction endonuclease sites in GA_Fragment_2.

| HPXV gene | Restriction endonuclease site created | Nucleotide change in the HPXV coding strand | Location in HPXV genome |
|---|---|---|---|
| HPXV044 | AvaI | A to C | 44,512 |
| | StuI | A to C | 45,061 |

Synthesis of the Slow (S) and Fast (F) Forms of the Terminal Hairpin Loops from VACV (Strain WR)

The Slow (S) and Fast (F) forms of the terminal hairpin loops from VACV (strain WR) are synthesized as 157nt ssDNA fragments (Integrated DNA Technologies; FIG. 2B). Through DNA synthesis, a 5' overhang comprised of three nucleotides is left at the end of each hairpin (5'-ACA; FIG. 2C). The concatamer resolution site from the HPXV sequence [DQ792504] is also synthesized in the terminal hairpin loops (FIG. 2B).

Digestion and Purification of scHPXV YFP-Gpt::095 Fragments

Synthetic HPXV fragments are digested with SfiI overnight at 50° C. The scHPXV ITR fragments are individually digested with SapI (Thermo Fisher Scientific©) for 1 h, inactivated at 65° C. for 10 minutes, before digestion with SfiI overnight at 50° C. Approximately 1U of FastAP alkaline phosphatase is added to the scHPXV YFP-gpt::095 ITR digestions and incubated at 37° C. for an additional 1 h. All scHPXV YFP-gpt::095 fragments are subsequently purified using a QiaexII DNA cleanup kit (Qiagen). All scHPXV YFP-gpt::095 fragments are eluted from the QiaexII suspension in 10 mM Tris-HCl. DNA concentrations are estimated using a NanoDrop (THERMO FISHER SCIENTIFIC©).

Results

Poxviruses catalyze very high-frequency homologous recombination reactions that are inextricably linked to the process of virus replication. Herein, it is demonstrated that large fragments of chemically synthesized HPXV duplex DNA can be joined to form a functional scHPXV genome using virus-catalyzed recombination and replication reactions.

Using the published sequence of the HPXV genome (strain WNR-76), the 212,633 bp genome is divided into 10-overlapping fragments (FIG. 2). All of the BsaI and AarI sites in every fragment except the ITRs are mutated, in case sequence-specific sites within this region are unknowingly required for efficient genome replication and concatamer resolution. As described above, to facilitate the addition of the terminal hairpin loop structures from VACV onto the end of the ITRs, a SapI recognition site is included next to the left- and right-terminal end of both LITR and RITR fragments, respectively (FIG. 2A). These SapI sites are embedded within the flanking vector sequences, and the SapI enzyme cuts downstream of the site, outside of the recognition sequence and in the HPXV DNA. Thus when DNA is cut with SapI, it leaves sticky ends within the DNA copied from the HPXV sequence and thus permits the assembly of a precise sequence copy (through a subsequent ligation), containing no extraneous restriction sites. The other ends of the LITR and RITR fragments (the internal ends with respect to the genome map) are each bounded by SfiI recognition sites, as are both ends of the remaining HPXV fragments. All of these DNAs are supplied in a plasmid form for easy propagation. To prepare the internal fragments for transfection into SFV-infected cells, these plasmids are digested with SfiI to release the plasmid from each scHPXV YFP-gpt::095 fragment (see below for how the LITR and RITR fragments are processed). Following digestion, each reaction is purified to remove any contaminating enzyme, but the plasmid is not removed from the digestion and is co-transfected alongside each scHPXV YFP-gpt::095 fragment. This does not interfere with the reaction and is done to minimize the amount of DNA manipulation and possible fragmentation of these large DNA fragments.

While the reaction efficiency may be affected by the number of transfected fragments, greater than or less than 10 overlapping fragments may be used in the methods of the invention. Without being bound by theory, ~15 fragments may represent a practical upper limit without further optimization of the reactivation reaction. The ideal lower limit would be a single genome fragment, but in practice the telomeres are most easily manipulated as more modest-sized fragments (e.g., ~10 kb).

Example 2. Ligation of VACV F- and S-Terminal Hairpin Loops onto scHPXV YFP-gpt::095 Left and Right ITR Fragments Materials and Methods Ligation of the S- and F-Forms of the Terminal Hairpin Loops onto scHPXV YFP-gpt::095 ITR Fragments Approximately one microgram of each of the terminal VACV hairpin loops is incubated at 95° C. for 5 minutes followed by a "snap" cool on ice to form the hairpin structure. The hairpin loops are subsequently phosphorylated at their 5' end before ligation. Briefly, separate 20 μl reactions containing 1 μg of either VACV F-hairpin or VACV S-hairpin, 2 μl of 10× T4 polynucleotide kinase buffer (THERMO FISHER SCIENTIFIC©), 1 mM ATP, and 10 units of T4 polynucleotide kinase (THERMO FISHER SCIENTIFIC©) are incubated at 37° C. for 1 h. The reaction is terminated by heat inactivation at 75° C.

Approximately one microgram of either left ITR or right ITR is incubated separately with a 20-fold molar excess of each terminal hairpin in the presence of 5% PEG-4000, and 5 units of T4 DNA ligase overnight at 16° C. Each ligation reaction is heat-inactivated at 65° C. for 10 minutes followed by incubation on ice until ready to transfect into cells.

Results

Orthopoxviruses encode linear dsDNA genomes bearing variable length inverted terminal repeats (ITR) at each end of the genome. The two strands of the duplex genome are connected by hairpin loops to form a covalently continuous polynucleotide chain. The loops are A+T-rich, cannot form a completely base-paired structure, and exist in two forms that are inverted and complementary in sequence (Baroudy B M, Venkatesan S, Moss B). Incompletely base-paired flip-flop terminal loops link the two DNA strands of the vaccinia virus genome into one uninterrupted polynucleotide chain. Cell. 1982; 28(2):315-24) (FIG. 2B). They are called slow [S] and fast [F] forms based upon their electrophoretic properties and probably fold into partially duplex hairpin structures that cap the ends of the linear dsDNA genome (FIG. 2C). The published sequence of the HPXV genome is incomplete, probably missing ~60 bp from the terminal ends, making it impossible to precisely replicate the HPXV hairpins. Instead, 157 nt ssDNA fragments were chemically synthesized using the published sequence of the VACV telomeres as a guide and leaving a 5' overhang comprised of three nucleotides at the end of each hairpin (5'-ACA; FIG. 2C) (Baroudy BM, Venkatesan S, Moss B). Incompletely base-paired flip-flop terminal loops link the two DNA strands of the vaccinia virus genome into one uninterrupted polynucleotide chain. Cell. 1982; 28(2):315-24). This overhang is complementary to the ends generated by cutting cloned LITR and RITR fragments with SapI.

Sequences derived from VACV are used based upon data suggesting a close common ancestry between HPXV and VACV. It may be possible to use other terminal hairpins from other poxviruses since there are sequence features that are commonly conserved between the hairpin ends of different Chordopoxviruses. For example, the resolution sites in the hairpin ends are highly conserved in both sequence and functionality (they resemble late promoters).

These single-stranded oligonucleotides are heated to 95° C. and then quickly chilled on ice to form the incompletely base-paired terminal hairpin (FIG. 2C). Next, each oligonucleotide is phosphorylated and ligated separately at 20-fold molar excess with either the left or right ITR fragment previously digested with both SapI and SfiI. Digestion of the ITRs with these enzymes results in a 5'-TGT overhang at the 5' termini of each ITR, which was complementary to the 5'-ACA overhang in the terminal hairpin loop structure. This produces a hairpin-terminated copy of each ITR.

To confirm that a hairpin-terminated structure is added to both ITR fragments, restriction digestion of the ITR fragments with PvuII is performed. Since it is impossible to visualize the addition of a ~70 bp terminal hairpin onto the terminus of a ~10 kb ITR by gel electrophoresis, a small amount of each ligation is digested with PvuII. If no terminal hairpin is ligated to the ITR, then digestion with PvuII results in a 1472 bp product (FIGS. 3A and 3B, lanes 2 and 5). If, however, the terminal hairpin loop is successfully added to the HPXV ITRs, then an increase in the size of the ITR fragment is seen on an agarose gel (FIG. 3B, compare lane 2 with 3 and 4; compare lane 5 with 6 and 7). These data suggest that under these conditions almost all of the HPXV ITRs contain terminal hairpin loops at one end of the fragment.

Example 3. Reactivation of scHPXV YFP-gpt::095 from Chemically Synthesized dsDNA Fragments Materials and Methods Viruses and Cell Culture SFV strain Kasza and BSC-40 were originally obtained from the American Type Culture Collection. Buffalo green monkey kidney (BGMK) cells were obtained from G. McFadden (University of Florida). BSC-40 and BGMK cells are propagated at 37° C. in 5% $CO_2$ in minimal essential medium (MEM) supplemented with L-glutamine, nonessential amino acids, sodium pyruvate, antibiotics and antimycotics, and 5% fetal calf serum (FCS; THERMO FISHER SCIENTIFIC©).

Reactivation of scHPXV YFP-gpt:: 095 in Shope Fibroma Virus-Infected Cells

Buffalo green monkey kidney (BGMK) cells are grown in MEM containing 60 mm tissue-culture dishes until they reached approximately 80% confluency. Cells are infected with Shope Fibroma Virus (SFV) in serum-free MEM at a MOI of 0.5 for 1 h at 37° C. The inoculum is replaced with 3 ml of warmed MEM containing 5% FCS and returned to the incubator for an additional hour. Meanwhile, transfection reactions are set up as follows. Lipofectamine complexes are prepared by mixing approximately 5 μg total synthetic HPXV DNA fragments in 1 ml OPTI-MEM© with Lipofectamine2000 diluted in 1 ml OPTI-MEM® at a ratio of 3:1 (Lipofectamine2000 to total DNA). A sample calculation to determine the relative amount of each HPXV fragment is shown in Table 4. The complexes are incubated at room temperature for 10 minutes and then added dropwise to the BGMK cells previously infected with SFV. Approximately 16h post infection, the media is replaced with fresh MEM containing 5% FCS. The cells are cultured for an additional 4d (total of 5d) at 37° C. Virus particles were recovered by scraping the infected cells into the cell culture medium and performing three cycles of freezing and thawing. The crude extract is diluted 10' in serum-free MEM and 4 ml of the inoculum is plated on 9-16 150 mm tissue culture plates of BSC-40 cells to recover reactivated scHPXV YFP-gpt::095. One hour post infection, the inoculum is replaced with MEM containing 5% FCS and 0.9% Noble Agar. Yellow fluorescent plaques are visualized under an inverted microscope and individual plaques are picked for further analysis. ScHPXV YFP-gpt::095 plaques are plaque purified three times with yellow fluorescence selection.

TABLE 4

Sample calculation of the quantity of each GA_HPXV fragment transfected into SFV-infected BGMK cells.

| fragment | frag. length | Ratio (frag. length:genome length) | Amount of DNA to transfect (ng) ~1 μg | ~3 μg | ~5 μg |
|---|---|---|---|---|---|
| GA_LITR + F-hairpin | 10,165 | 0.05 | 50 | 150 | 250 |
| GA_LITR + S-hairpin | 10,165 | 0.05 | 50 | 150 | 250 |
| GA_Frag_1A | 16,257 | 0.08 | 80 | 240 | 400 |
| GA_Frag_1B | 16,287 | 0.08 | 80 | 240 | 400 |
| GA_Frag_2 | 31,946 | 0.15 | 150 | 450 | 750 |
| GA_Frag_3 | 25,566 | 0.12 | 120 | 450 | 600 |
| GA_Frag_4 | 28,662 | 0.13 | 130 | 390 | 650 |
| GA_Frag_5 | 30,252 | 0.14 | 140 | 420 | 700 |
| GA_Frag_6 | 30,000 | 0.14 | 140 | 420 | 700 |
| GA_Frag_7 | 28,754 | 0.13 | 130 | 390 | 650 |
| GA_RITR + F-hairpin | 8,554 | 0.04 | 40 | 120 | 200 |
| GA_RITR + S-hairpin | 8,554 | 0.04 | 40 | 120 | 200 |

Results

SFV-catalyzed recombination and reactivation of Orthopoxvirus DNA to assemble recombinant vaccinia viruses has previously been described (Yao X D, Evans D H. High-frequency genetic recombination and reactivation of orthopoxviruses from DNA fragments transfected into leporipoxvirus-infected cells. Journal of Virology. 2003; 77(13):7281-90; and Yao X D, Evans D H. Construction of recombinant vaccinia viruses using leporipoxvirus-catalyzed recombination and reactivation of orthopoxvirus DNA. Methods Mol Biol. 2004; 269:51-64). Several biological features make this an attractive model system. First, SFV has a narrow host range, productively infecting rabbit cells and certain monkey cell lines, like BGMK. It can infect, but grows very poorly on cells like BSC-40. Second, it grows more slowly compared to Orthopoxviruses, taking approximately 4-5 days to form transformed "foci" in monolayers of cells, a characteristic that is very different from Orthopoxviruses, which produce plaques within 1-2 days in culture. This difference in growth between Leporipoxviruses and Orthopoxviruses allows one to differentiate these viruses by performing the reactivation assays in BGMK cells and plating the progeny on BSC-40 cells. In some embodiments, other helper viruses (such as but not limited to fowlpox virus) may be used. In some embodiments, different cell combinations may be used.

BGMK cells are infected with SFV at a MOI of 0.5 and then transfected with 5 μg of digested GA_HPXV fragments (Table 4) 2 h later. Five days post transfection all of the infectious particles are recovered by cell lysis and re-plated on BSC-40 cells, which only efficiently support growth of HPXV (or other Orthopoxviruses). The resulting reactivated scHPXV YFP-gpt::095 plaques are visualized under a fluorescence microscope. The visualization is enabled by the yfp/gpt selectable marker in the HPXVO95/J2R locus within Frag_3 (FIG. 2A). Virus plaques are detected in BSC-40 monolayers within 48 h of transfection. The efficiency of recovering scHPXV YFP-gpt::095 is dependent on a number of factors, including DNA transfection efficiency, but ranges up to a few PFU/pg of DNA transfected.

Example 4. Confirmation of scHPXV YFP-gpt::095 Genome Sequence by PCR and Restriction Fragment Analysis Materials and Methods PCR and Restriction Digestion Analysis of scHPXV To rapidly confirm the presence of scHPXV YFP-gpt::095 in reactivated plaque picks, PCR primers are designed to flank individual BsaI sites that were mutated in the scHPXV (Table 5). Genomic scHPXV YFP-gpt::095 DNA is isolated from BSC-40 cells infected with scHPXV YFP-gpt::095 and used as a template. Genomic DNA from VACV-infected BSC-40 cells is used as a control to confirm the presence of BsaI sites within each PCR product. Following PCR amplification, reactions are subsequently digested with BsaI for 1 h at 37° C. PCR reactions are separated on a 1% agarose gel containing SYBR® safe stain to visualize DNA bands.

Further analysis of scHPXV YFP-gpt::095 genomes by restriction digestion followed by pulse-field gel electrophoresis (PFGE) is carried out on genomic DNA isolated using sucrose gradient purification (Yao XD, Evans DH. Construction of recombinant vaccinia viruses using leporipoxvirus-catalyzed recombination and reactivation of orthopoxvirus DNA. Methods Mol Biol. 2004; 269:51-64). Briefly, 100 ng of purified viral genomic DNA is digested with 5U of BsaI or HindIII for 2 h at 37° C. Digested DNA is run on a 1% Seakem Gold agarose gel cast and run in 0.5× tris-borate-EDTA electrophoresis (TBE) buffer [110 mM tris; 90 mM borate; 2.5 mM EDTA]. The DNA is resolved on a CHEF DR-III apparatus (BioRad) at 5.7V/cm for 9.5h at 14° C., using a switching time gradient of 1 to 10s, a linear ramping factor, and a 1200 angle. This program allows resolution of DNA species from 1 kbp to >200 kbp. To resolve fragments from 75 bp to 5 kbp, electrophoresis on 1.5% agarose gel cast and run in 1.0× TBE at 115V for 2 h at room temperature is carried out. The DNA is visualized with SYBR® gold stain. The size of digested scHPXV YFP-gpt::095 DNA fragments is compared to control VACV genomic DNA.

TABLE 5

Primers that are used in this study to amplify regions within VACV and HPXV surrounding the BsaI restriction sites found in GA_Fragment_1A, GA_Fragment_1B, GA_Fragment_2, GA_Fragment_3, GA_Fragment_4, GA_Fragment_5, GA_Fragment_6, and GA_Fragment_7.

| Primer Name | Primer sequence (5 to 3') | Position of BsaI site in VACV [NC_6998] | Position of BsaI site in HPXV [DQ792504] |
|---|---|---|---|
| HPXV 1A-FWD (SEQ ID NO: 13) | CTGTATACCCATACTGAATTGATGAAC | 16,756 | 27,849 |
| HPXV 1A-REV (SEQ ID NO: 14) | GAGTTAATATAGACGACTTTACTAAAGTCATG | | |
| HPXV 1B-FWD (SEQ ID NO: 15) | GGTTCTTTTTATTCTTTTAAACAGATCAATGG | 23,076 | N/A |
| HPXV 1B-REV (SEQ ID NO: 16) | TTCTTATTAAGACATTGAGCCCAGC | | |
| HPXV 2A-FWD (SEQ ID NO: 17) | AGTCATCAATCATCATTTTTTCACC | 30,073 | 41,225 |
| HPXV 2A-REV (SEQ ID NO: 18) | ATATAACGGACATTTCACCACC | | |
| HPXV 2B-FWD (SEQ ID NO: 19) | GTAACATATACAACTTTTATTATGGCGTC | 45,485 | 56,778 |
| HPXV 2B-REV (SEQ ID NO: 20) | CTAATCCACAAAAAATAGAATGTTTAGTTATTTTG | | |
| HPXV 2C-FWD (SEQ ID NO: 21) | AGTGACTGTATCCTCAAACATCC | 56,576 | 67,839 |
| HPXV 2C-REV (SEQ ID NO: 22) | TTTATAAAGGGTTAACCTTTGTCACATC | | |
| HPXV 3A-FWD (SEQ ID NO: 23) | TTGTGTAGCGCTTCTTTTTAGTC | 60,981 | N/A |
| HPXV 3A-REV (SEQ ID NO: 24) | AAACGGATCCATGGTAGAATATG | | |
| HPXV 3B-FWD (SEQ ID NO: 25) | TATTTGCATCTGCTGATAATCATCC | 84,916 | 84,353 |
| HPXV 3B-REV (SEQ ID NO: 26) | CGATGGATTCAAATGACTTGTTAATG | | |
| HPXV 4A-FWD (SEQ ID NO: 27) | ATGCCTTTACAGTGGATAAAGTTAAAC | 85,101 | 96,243 & 96,428 |
| HPXV 4A-REV (SEQ ID NO: 28) | CTGGATCCTTAGAGTCTGGAAG | | |
| HPXV 4B-FWD (SEQ ID NO: 29) | CGGAAAATGAAAAGGTACTAGATACG | 98,134 | 109,485 |
| HPXV 4B-REV (SEQ ID NO: 30) | TGAATAGCCGTTAAATAATCTATTTCGTC | | |
| HPXV 4C-FWD (SEQ ID NO: 31) | TATGGATACATTGATAGCTATGAAACG | 99,302 & 99,481 | 110,653 & 110,832 |
| HPXV 4C-REV (SEQ ID NO: 32) | AATACATCTGTTAAAATTGTTTGACCCG | | |
| HPXV 5A-FWD (SEQ ID NO: 33) | CATTTTATTTCTAGACGTTGCCAG | 111,686 | 123,037 |
| HPXV 5A-REV (SEQ ID NO: 34) | CGATATGAAACTTCAGGCGG | | |
| HPXV 5B-FWD (SEQ ID NO: 35) | ACAAAACGATTTAATTACAGAGTTTTCAG | 122,484 | N/A |
| HPXV 5B-REV (SEQ ID NO: 36) | GTCCGGTATGAGACGACAG | | |
| HPXV 5C-FWD (SEQ ID NO: 37) | TTAGGGATCACATGAATGAAATTCG | 133,505, | 144,838 |
| HPXV 5C-REV (SEQ ID NO: 38) | TATGGAAGTTCCGTTTCATCCG | | |
| HPXV 5D-FWD (SEQ ID NO: 39) | GACTTGATAATCATATATTAAACACATTGGATC | 138,306 | 149,718 |
| HPXV 5D-REV (SEQ ID NO: 40) | AGATCTCCAGATTTCATAATGATCAC | | |

TABLE 5-continued

Primers that are used in this study to amplify regions within VACV and HPXV surrounding the BsaI restriction sites found in GA_Fragment_1A, GA_Fragment_1B, GA_Fragment_2, GA_Fragment_3, GA_Fragment_4, GA_Fragment_5, GA_Fragment_6, and GA_Fragment_7.

| Primer Name | Primer sequence (5 to 3') | Position of BsaI site in VACV [NC_6998] | Position of BsaI site in HPXV [DQ792504] |
|---|---|---|---|
| HPXV 6A-FWD (SEQ ID NO: 41) | ATGATACGTACAATGATAATGATACAGTAC | 163,521 | 175,062 |
| HPXV 6A-REV (SEQ ID NO: 42) | TGATTTTTGCAATTGTCAGTTAACACAAG | | |
| HPXV 7A FWD (SEQ ID NO: 43) | TACTGTACCCACTATGAATAACGC | 169,035 | 180,578 |
| HPXV 7A-REV (SEQ ID NO: 44) | GATATCAACATCCACTGAAGAAGAC | | |
| HPXV 7B-FWD (SEQ ID NO: 45) | ATCTTACCATGTCCTCAAATAAATACG | 175,849 | 187,467 |
| HPXV 7B-REV (SEQ ID NO: 46) | ATAGCTCTAGGTATAGTCTGCAAG | | |
| HPXV 7C-FWD (SEQ ID NO: 47) | GCGAACTCCATTACACAAATATTTG | 181,952 | 195,683 |
| HPXV 7D-REV (SEQ ID NO: 48) | GATGTTTCTAAATATAGGTTCCGTAAGC | | |

Results

Figure 4A:
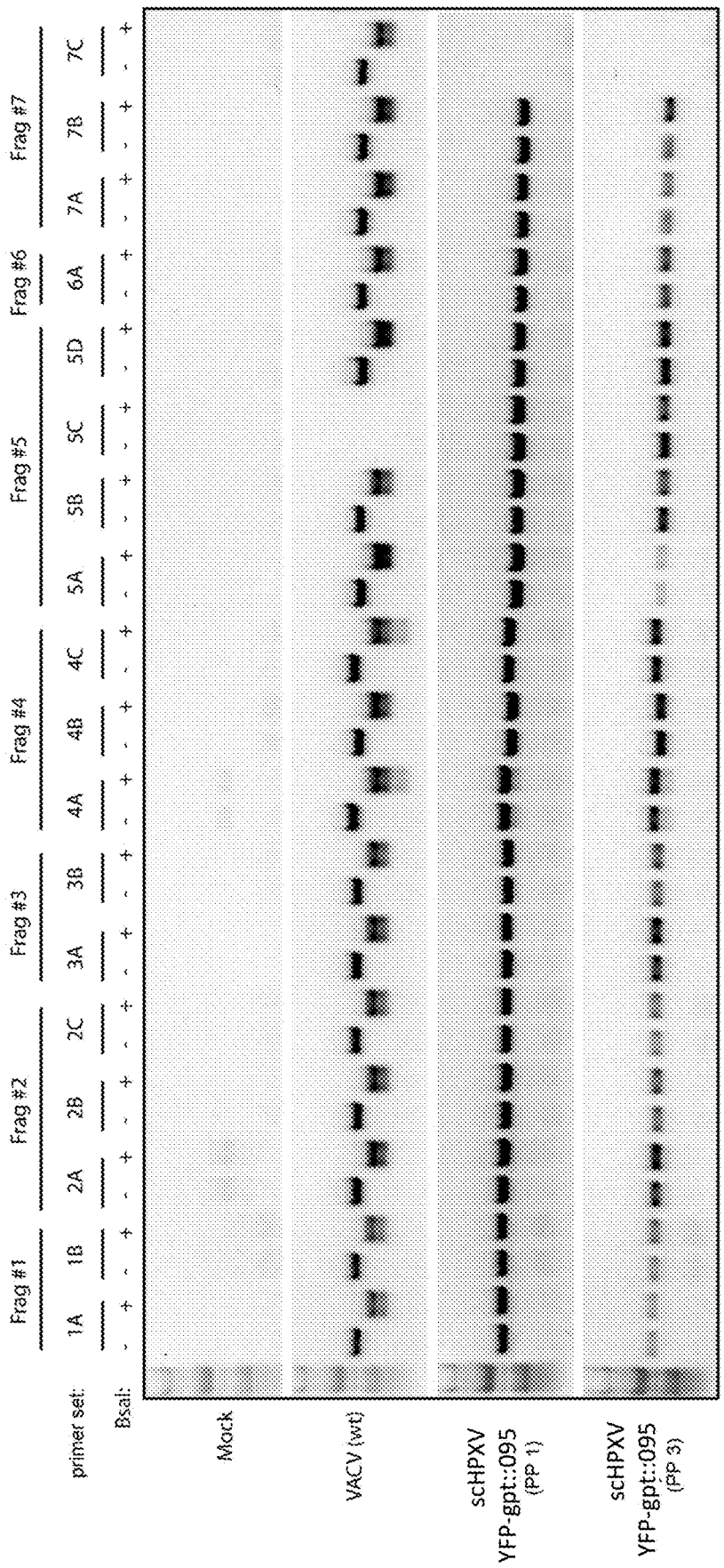

The genome sequence of virus isolated from plaques grown from the reactivation assay is confirmed by PCR, restriction digestion, and whole genome sequencing. The PCR analysis is based on the mutated BsaI sites within all but the ITR HPXV fragments. Primer sets are designed to flank each BsaI site in scHPXV YFP-gpt::095 (Table 5). It is confirmed that these primer sets would also amplify a similar region within VACV WR. After PCR amplification of an approximate 1 kb region surrounding these mutated BsaI sites within scHPXV YFP-gpt::095, each reaction is digested with BsaI and the resulting DNA fragments are analyzed by gel electrophoresis. Since no BsaI sites are mutated in VACV (wt), enzymatic digestion successfully digests each PCR product, resulting in a smaller DNA fragment (FIG. 4A, VACV). The PCR products generated from scHPXV YFP-gpt::095 genomic DNA are resistant to BsaI digestion, suggesting that the BsaI recognition site is successfully mutated in these genomes (FIG. 4A, scHPXV YFP-gpt::095 (PP1) and scHPXV YFP-gpt::095 (PP3)). The primer products for primer set 7C did not result in any amplification of DNA in the scHPXV YFP-gpt::095 PP1 and PP3 samples. To confirm whether this primer set was non-functional or if this area of Fragment 7 did not get assembled into the resulting scHPXV YFP-gpt::095 genome, PCR was performed on the original GA_Frag_7 plasmid DNA and this reaction was also unsuccessful in amplifying a product.

Figure 4B:
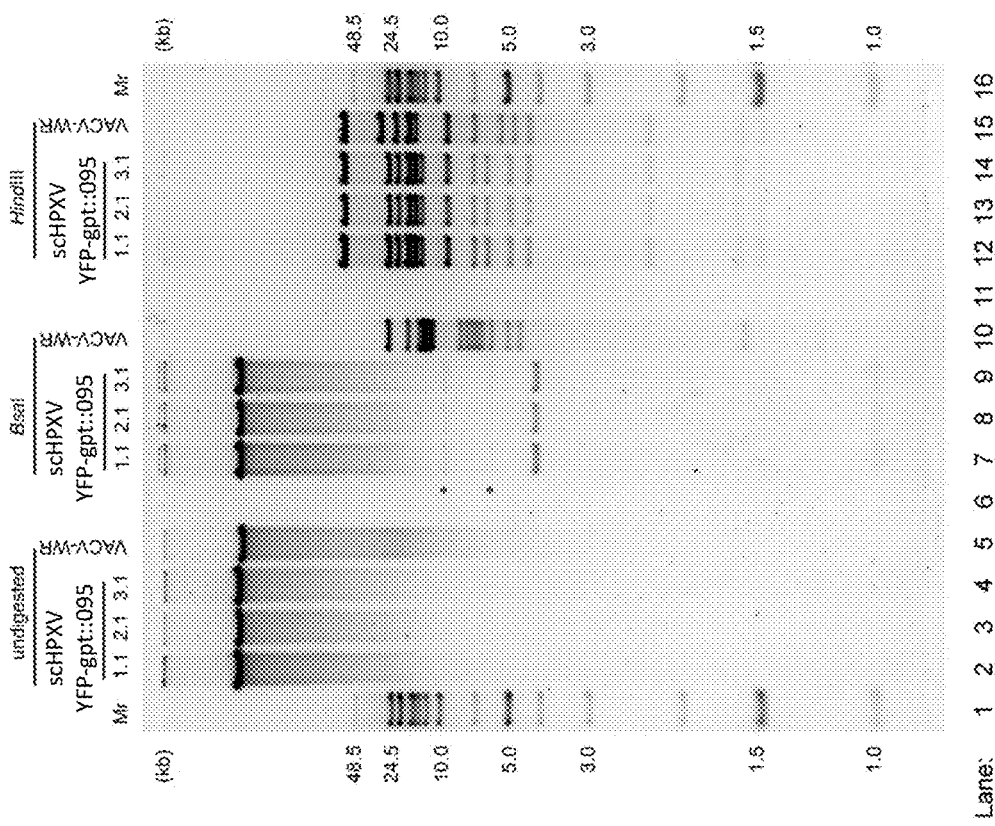
Figure 4C:
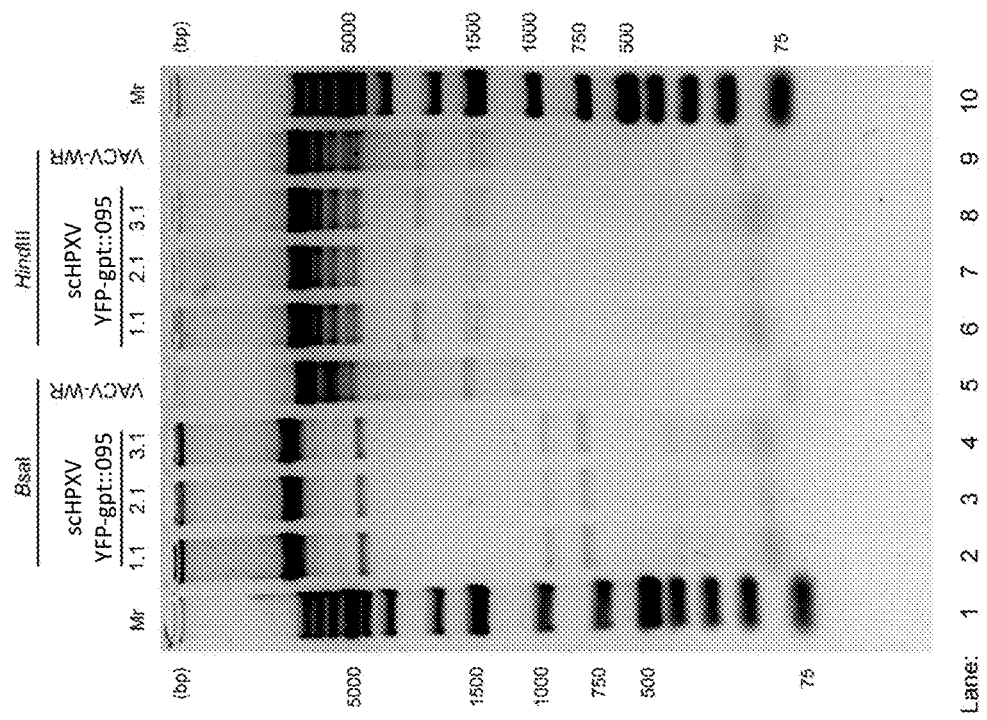

Genomic DNA is next isolated from sucrose-gradient purified scHPXV YFP-gpt::095 genomes, digested with BsaI or HindIII, and separated by agarose gel electrophoresis to confirm that the majority of the BsaI sites in scHPXV YFP-gpt::095 are successfully mutated. Interestingly, undigested genomic DNA from 3 different scHPXV YFP-gpt::095 clones run noticeably slower on a gel compared to VACV, confirming that the genome of scHPXV YFP-gpt::095 (213,305 bp) is larger than VACV-WR (194,711 bp) (FIG. 4B, compare lanes 2-4 with lane 5). The scHPXV YFP-gpt::095 clones are resistant to BsaI digestion, resulting in one large DNA fragment (~198000 bp) and a smaller DNA fragment at around 4000 bp after separation by PFGE (FIG. 4A, lane 7-9). This is in contrast to the VACV-WR genome, which when digested with BsaI, leads to a number of DNA fragments being separated on the gel (FIG. 4B, lane 10). Since the expected DNA sizes following digestion of scHPXV YFP-gpt::095 genome with BsaI are relatively small (Table 6), these digestion products are separated by conventional agarose gel electrophoresis and it is confirmed that the scHPXV YFP-gpt::095 generates the appropriate-sized fragments (FIG. 4C, lanes 2-4). It is also confirmed that scHPXV YFP-gpt::095 produces the correct size of DNA fragments following HindIII digestion, suggesting that these recognitions are maintained during synthesis of the large DNA fragments (Table 6; FIG. 4B, lanes 12-14; FIG. 4C, lanes 6-8). Overall, in vitro analysis of the scHPXV YFP-gpt::095 genome suggests that reactivation of HPXV from chemically synthesized DNA fragments is successful.

TABLE 6

Expected sizes of scHPXV YFP-gpt::095 DNA fragments digested with either BsaI or HindIII.

| Fragment # | scHPXV YFP-gpt::095 digested with BsaI (bp) | scHPXV YFP-gpt::095 digested with HindIII (bp) |
|---|---|---|
| 1 | 198,833 | 53,822 |
| 2 | 4046 | 24,848 |
| 3 | 4046 | 19,283 |
| 4 | 968 | 16,056 |
| 5 | 968 | 15,176 |
| 6 | 778 | 13,836 |
| 7 | 778 | 13,558 |
| 8 | 767 | 12,679 |
| 9 | 767 | 8877 |
| 10 | 391 | 8637 |

TABLE 6-continued

Expected sizes of scHPXV YFP-gpt::095 DNA fragments digested with either BsaI or HindIII.

| Fragment # | scHPXV YFP-gpt::095 digested with BsaI (bp) | scHPXV YFP-gpt::095 digested with HindIII (bp) |
|---|---|---|
| 11 | 391 | 6493 |
| 12 | 138 | 5803 |
| 13 | 138 | 4631 |
| 14 | 64 | 4115 |
| 15 | 60 | 2216 |
| 16 | 54 | 1560 |
| 17 | 54 | 1442 |
| 18 | 32 | 273 |
| 19 | 32 |  |

Since HJPXV095 encodes the HPXV homolog of the non-essential VACV J2R gene, by co-transfecting Fragment_3 and other HPXV clones into SFV-infected BGMK cells, along with VACV DNA, a variety of hybrid viruses are recovered, validating the selection strategy (FIGS. 10A and 10B). The first hybrid virus ("VACV/HPXV+fragment 3") is obtained by co-transfecting VACV DNA with HIPXV Frag_3 (FIG. 1) into SFV-infected cells. The green-tagged insertion encodes the YFP-gpt selection marker. Clones 1-3 are obtained by purifying the DNA from this first hybrid genome and transfecting it again, along with HPXV fragments 2, 4, 5, and 7, into SFV-infected cells. PCR primers were designed to target both HPXV and VACV (Table 5) are used to amplify DNA segments spanning the BsaI sites that are mutated in the scHPXV clones. Following PCR amplification, the products are digested with BsaI to differentiate VACV sequences (which cut) from HPXV (which do not cut). The VACV/HPXV hybrids exhibit a mix of BsaI sensitive and resistant sites whereas the reactivated scHPXV YFP-gpt::095 clone is fully BsaI resistant.

Example 5. Confirmation of scHPXV YFP-gpt::095 Genome Sequence by Whole Genome Sequence Analysis Materials and Methods
Virus DNA Isolation and Sequencing Stocks of HPXV YFP-gpt::095 clones (plaque pick [PP] 1.1, PP 2.1, and PP 3.1]) are prepared and purified over sucrose gradients. Viral DNAs are extracted from each purified virus preparation using proteinase K digestion followed by phenol-chloroform extraction. The amount of dsDNA is determined using a Qubit dsDNA HS assay kit (THERMO FISHER SCIENTIFIC©). Each viral genome is sequenced at the Molecular Biology Facility (MBSU) at the University of Alberta. Sequencing libraries are generated using the Nextera Tagmentation system (Epicentre Biotechnologies). Approximately 50 ng of each sample is sheared and library prepped for paired end sequencing (2×300 bp) using an ILLUMINA©MiSeq platform with an average read depth of 3,100 reads $nt^{-1}$ across the genome and ~190 reads $nt^{-1}$ in the F- and S-hairpins.

Sequence Assembly, Analysis, and Annotation

Raw sequencing reads are trimmed of low-quality sequence scores and initially mapped to the HPXV reference sequence [GenBank Accession DQ792504]using CLC Genomics Workbench 8.5 software. All nucleotide insertions, deletions, and substitutions within the scHPXV YFP-gpt::095 sequence are verified against the HPXV reference sequence. The Genome Annotation Transfer Utility (GATU) (Tcherepanov V, Ehlers A, Upton C. Genome Annotation Transfer Utility (GATU): rapid annotation of viral genomes using a closely related reference genome. BMC Genomics. 2006; 7:150. Epub 2006/06/15) is used to transfer the reference annotation to the scHPXV genome sequences.

Results

Purified scHPXV YFP-gpt::095 genomes are sequenced using a multiplex approach and an ILLUMINA©MiSeq sequencer. The sequence reads are mapped onto the wild-type HPXV (DQ792504) and scHPXV YFP-gpt::095 reference sequences to confirm the presence of specific modifications in the scHPXV YFP-gpt::095 genome. To confirm that the VACV terminal repeat sequences are correctly ligated onto the terminal end of the left ITR, sequencing reads in this area of the genome are analyzed. A string of Cs is added to the beginning of the scHPXV YFP-gpt::095 genome reference sequence to capture all of the sequence reads that mapped in this region. This is done because the program used to assemble the sequence reads will otherwise truncate the display of sequences at the point where the scHPXV YFP-gpt::095 genome reference sequence ends.

It is clear from the mapped reads that although the SapI recognition site is present in the scHPXV YFP-gpt::095 reference genome, all of the sequencing reads lack this sequence. This confirms that the approach described herein produces an authentic HPXV sequence at the site where the synthetic hairpin was ligated to the ends of the ITRs. The complete sequence of the VACV WR terminal hairpin loop is also successfully obtained, which proves to be identical to the sequence of the synthetic ssDNA that is ligated onto the TIR ends. Overall, these data suggest that the VACV-WR terminal hairpin loops are successfully ligated onto the HPXV ITR sequences and recovered in the infectious viruses. Moreover, the 1:1 distribution of F- and S-reads in each of five viruses suggested that both ends are required to produce a virus.

Next, it is verified that each nucleotide substitution to silently mutate the BsaI sites has correctly been incorporated into the scHPXV YFP-gpt::095 genome. Sequencing reads are mapped to the HPXV (DQ792504) reference sequence. The overall ILLUMINA©sequencing read covers scHPXV YFP-gpt::095 from region 96,050 to 96,500. There are two conflicts in this region that do not align correctly with reference HPXV. Upon magnification of these regions it is clear that at position 96,239 there is a T to C substitution and at position 96,437 there is an A to G substitution in the scHPXV YFP-gpt::095 genome. It was verified that all of the nucleotide substitutions that are introduced in order to mutate the selected BsaI and AarI recognition sites are created in the scHPXV YFP-gpt::095 genome (Table 2).

Finally, it is determined that the nucleotide substitutions in HPXV044, designed to create unique restriction sites in GA_Frag_2, are also incorporated into the scHPXV YFP-gpt::095 genome. The sequencing reads that map to HPXV044 (region 44,400 to 45,100). Within this region there are two regions where the sequencing reads conflict with that of the sequence in the HPXV YFP-gpt::095 reference sequence. Upon magnification of these regions, it is clear that two T to G substitutions are introduced into the non-coding strand of HPXV044 at positions 44,512 and 45,061, thus creating AvaI and StuI restriction sites in Frag_2. Overall, the sequencing data corroborates the in vitro genomic analysis data and confirms that scHPXV YFP-gpt::095 is successfully reactivated in SFV-infected cells.

Example 6. ScHPXV YFP-gpt::095 Replicates More Slowly in HeLa Cells Compared to Other Poxviruses Materials and Methods BSC-40, HeLa, and HEL fibroblasts were originally obtained from the American Type Culture Collection. BSC-40 cells are propagated at 37° C. in 5% $CO_2$ in minimal essential medium (MEM) supplemented with L-glutamine, nonessential amino acids, sodium pyruvate, antibiotics and antimycotics, and 5% fetal calf serum (FCS; THERMO FISHER SCIENTIFIC©). HeLa and HEL cells are propagated at 37° C. in 5% $CO_2$ in Dulbecco's modified Eagle's medium supplemented with L-glutamine, antibiotics and antimycotics, and 10% FCS.

Results

Multi-step growth curves and plaque size measurements are used to evaluate whether scHPXV YFP-gpt::095 replicated and spread in vitro similar to other Orthopoxviruses. Since a natural HPXV isolate is unavailable, the growth of scHPXV YFP-gpt::095 is compared to the prototypic poxvirus, VACV (strain WR), Cowpox virus (CPX), a poxvirus that is closely related to HPXV and a clone of Dryvax virus, DPP15. Monkey kidney epithelial cells (BSC-40), Vero cells, a human carcinoma cell line (HeLa), and primary human fibroblasts cells (HEL) are infected with VACV WR, CPX, DPP15, or scHPXV YFP-gpt::095 at a low MOI and infected cells are harvested over a 72 h time course. In BSC-40 cells, the rate of virus replication and spread is comparable among all viruses tested (FIG. 5A). Importantly, scHPXV YFP-gpt::095 replicates as well as any of the other poxviruses tested. The virus grew to somewhat lower titers on HEL cells and Vero cells, and least well on HeLa cells. In HeLa cells, up to a 1.5-log decrease in virus production is seen compared to other Orthopoxviruses.

Figure 5B:
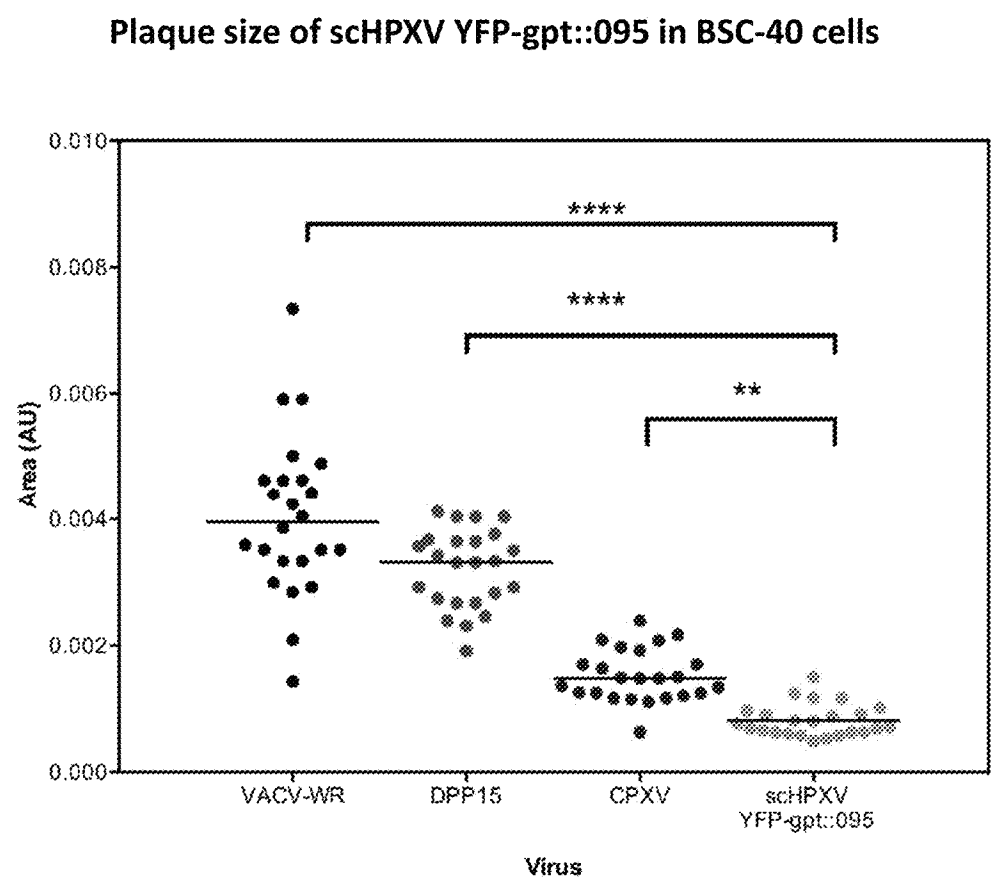

Next, the plaque size of scHPXV YFP-gpt::095 grown in BSC-40 cells is measured. A statistically significant decrease in plaque size of scHPXV YFP-gpt::095 compared to VACV WR and even cowpox virus (FIG. 5B) is observed. Interestingly, in BSC-40 cells, scHPXV YFP-gpt::095 produces the smallest plaques when compared to all other Orthopoxviruses tested (FIG. 5C). Also, while different VACV strains produce extracellular viruses that form smaller secondary plaques, these are not produced by scHPXV YFP-gpt::095 (FIG. 5C). Overall, these data suggest that reactivation of scHPXV YFP-gpt::095 using the system described herein does not introduce any obvious defects in virus replication and spread in vitro when compared to other Orthopoxviruses. Moreover, the plaque size of scHPXV YFP-gpt::095 is similar to that of cowpox virus (CPXV), suggesting that synthetic virus reactivation does not have any deleterious effects on the small plaque phenotype that has previously been observed with other HPXV-like clones (Medaglia ML, Moussatche N, Nitsche A, Dabrowski PW, Li Y, Damon I K, et al. Genomic Analysis, Phenotype, and Virulence of the Historical Brazilian Smallpox Vaccine Strain IOC: Implications for the Origins and Evolutionary Relationships of Vaccinia Virus. Journal of Virology. 2015; 89(23):11909-25).

Example 7. Removal of yfp/gpt Selection Marker

Following reactivation of the scHPXV YFP-gpt::095, the yfp/gpt selection marker in the HPXV095 locus is removed. To do this, a 1349 bp region of sequence corresponding to nucleotide positions 91573 to 92921 in HPXV (DQ792504) is synthesized (THERMO FISHER SCIENTIFIC©) (SEQ ID NO: 60). This fragment included approximately 400 bp of homology flanking either side of the wt HPXV095/J2R gene. This sequence of DNA is cloned into a commercial vector provided by GENEART®. To replace the yfp/gpt cassette with the HPXV095 gene sequence, BSC-40 cells are infected with scHPXV YFP-gpt::095 at a MOI of 0.5 and then transfected, 2 h later, with 2 μg of linearized plasmid containing the wtHPXV095 sequence using Lipofectamine 2000 (THERMO FISHER SCIENTIFIC©). The virus recombinants are harvested 48 h post infection and recombinant viruses (scHPXV (wt)) are isolated using three rounds of non-fluorescent plaque purification under agar. PCR is used to confirm the identity of the scHPXV (wt) using primers that flank the HPXV095 gene locus. The primers used to confirm the correct replacement of the HPXV095 gene are HPXV095_check-FWD 5'-CCTATTA-GATACATAGATCCTCGTCG-3' (SEQ ID NO: 61) and HPXV095_check-REV 5'-CGGTT-TATCTAACGACACAACATC-3' (SEQ ID NO: 62).

Example 8. Growth Properties of scHPXV (wt) Versus scHPXV YFP-gpt::095

Figure 11A:
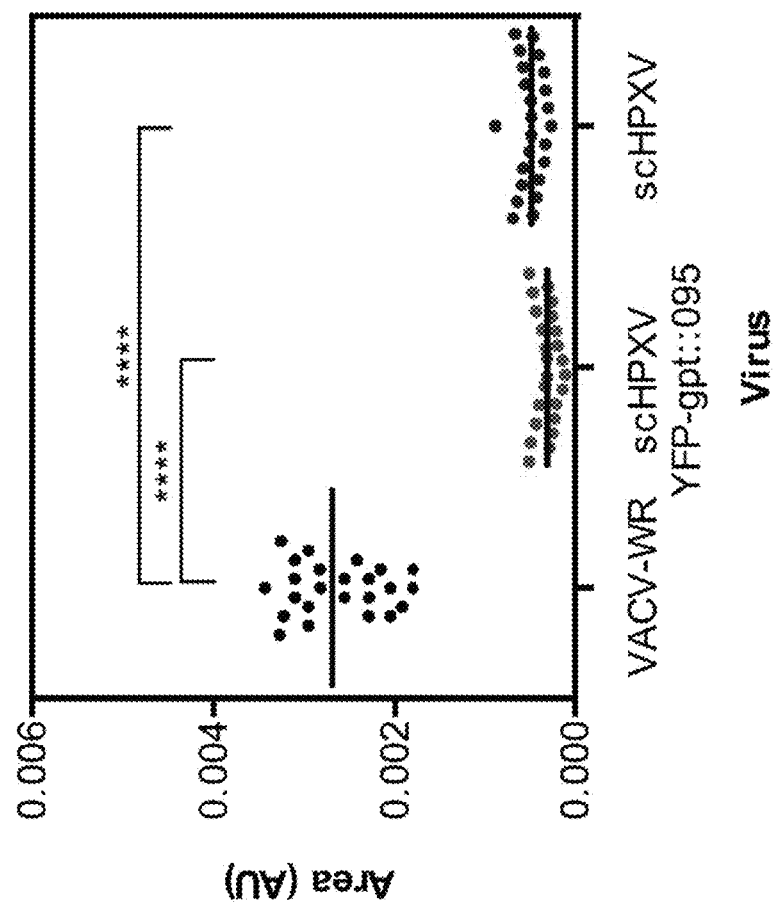
Figure 11B:
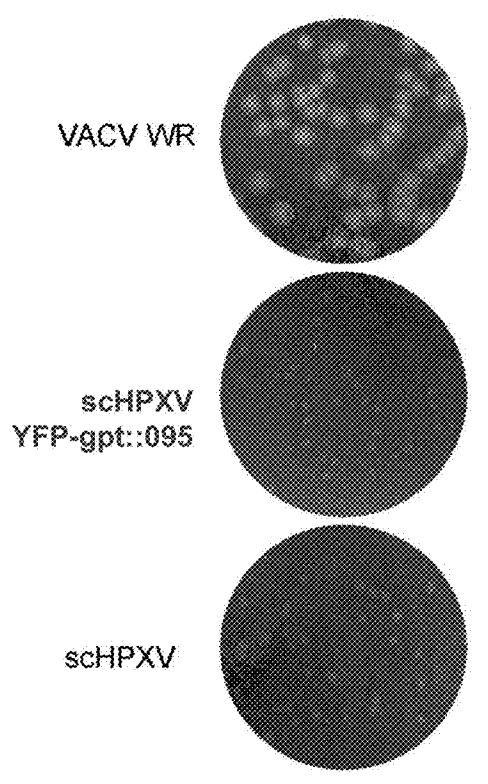
Figure 11C:
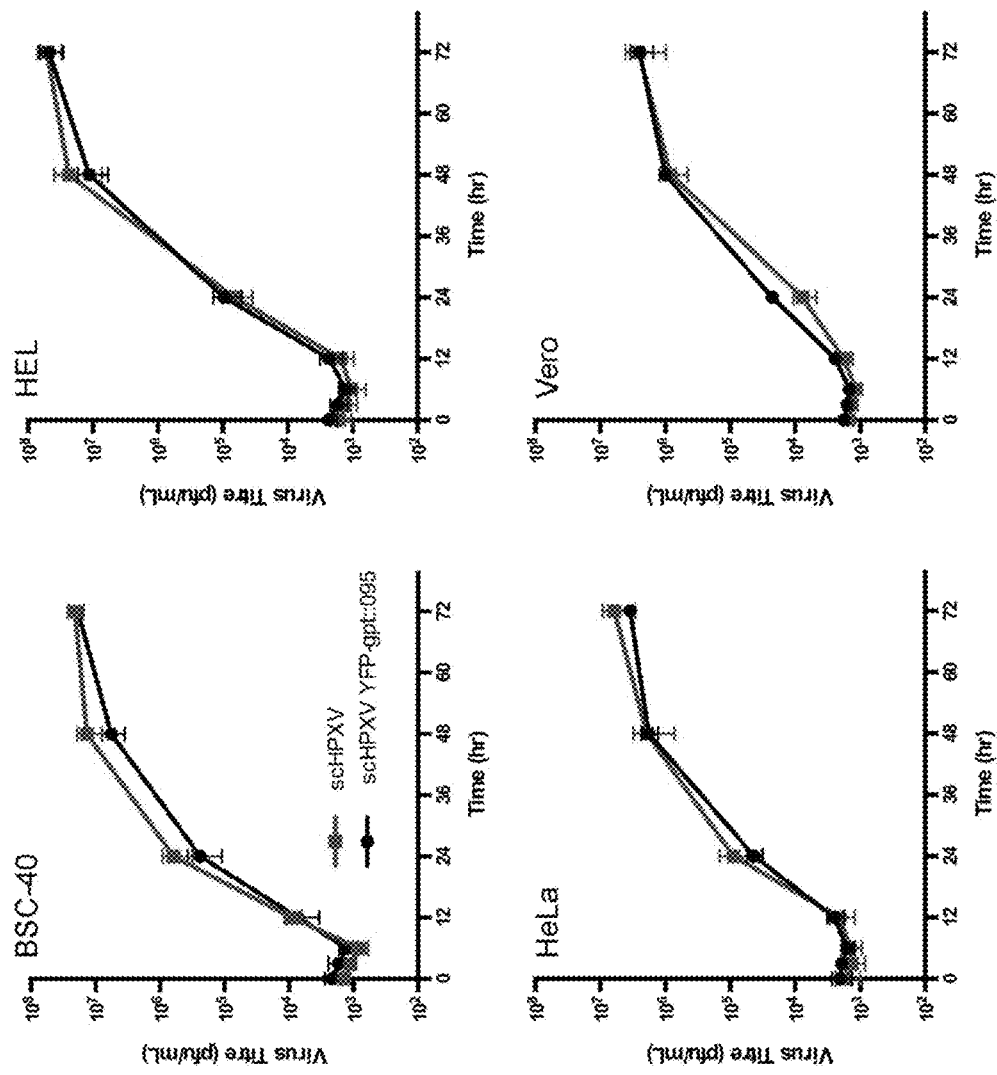

In experiments performed as described above in Example 6, scHPXV (wt) shows growth properties not significantly different from scHPXV YFP-gpt::095 in vitro (FIG. 11A-C). A statistically significant decrease in plaque size of scHPXV (wt) compared to VACV WR is observed (FIG. 11A). scHPXV (wt), like scHPXV YFP-gpt::095, does not produce extracellular viruses (FIG. 11B) and there are no significant differences in the growth of scHPXV (wt) and scHPXV YFP-gpt::095 on BSC-40 cells, HEL cells, HeLA cells, and Vero cells (FIG. 11C). The finding that scHPXV (wt) does not produce extracellular viruses is of relevance given that this property affects virulence.

Example 9. Determination of the Virulence of scHPXV (wt) in a Murine Intranasal Model The toxicity effects of scHPXV (wt) are determined in this study. For this experiment, 6 groups of Balb/c mice are administered 3 different doses of scHPXV (ΔHPXV_095/J2R) or scHPXV (wt) described in Examples 1-7 and compared to a PBS control group as well as a VACV (WR) control group and a VACV (Dryvax strain DPP15) control group (9 treatment groups in total). There are 3 additional mice included in this experiment that do not receive any treatment for the duration of the study. All mice are sampled for blood at predetermined points throughout the experiment and the additional mice serve as a baseline for serum analysis.

Prior to inoculation of Balb/c mice, all virus strains are grown in BSC-40 cells (African green monkey kidney), harvested by trypsinization, washed in PBS, extracted from cells by dounce homogenization, purified through a 36% sucrose cushion by ultracentrifugation, resuspended in PBS, and titered such that the final concentrations are: 1) VACV (WR)—$5 \times 10^5$ PFU/ml; 2) VACV (DPP15)—$10^9$ PFU/ml; 3) scHPXV (ΔHPXV_095/J2R)—$10^7$ PFU/ml, $10^8$ PFU/ml, and $10^9$ PFU/ml and 4) scHPXV (wt)—$10^7$ PFU/ml, 108 PFU/ml, and $10^9$ PFU/ml.

The scHIPXV doses chosen for this study ($10^5$ PFU/dose, $10^6$ PFU/dose, and $10^7$ PFU/dose) are based on previous studies using known vaccine strains of VACV, including Dryvax and IOC (Medaglia ML, Moussatche N, Nitsche A, Dabrowski PW, Li Y, Damon I K, et al. Genomic Analysis, Phenotype, and Virulence of the Historical Brazilian Smallpox Vaccine Strain IOC: Implications for the Origins and Evolutionary Relationships of Vaccinia Virus. Journal of Virology. 2015; 89(23):11909-25; Qin L, Favis N, Famulski J, Evans DH. Evolution of and evolutionary relationships between extant vaccinia virus strains. Journal of Virology. 2015; 89(3):1809-24).

Since weight loss is used as a measurement of virulence in mice, VACV (strain WR) is administered intranasally at a dose of $5\times10^3$ PFU, which leads to approximately 20-30% weight loss. The VACV Dryvax clone, DPP15, is also administered intranasally at $10^7$ PFU/dose, so that the virulence of this well-known Smallpox vaccine can be directly compared to scHPXV (wt). Mice are purchased from Charles River Laboratories and once received, are acclimatized to their environment for at least one week prior to virus administration.

Each mouse receives a single dose of virus (~10 ul) administered via the intranasal injection while under anesthesia. Mice are monitored for signs of infection, such as swelling, discharge, or other abnormalities every day for a period of 30 days. Each mouse is specifically monitored for weight loss every day after virus administration. Mice that lose more than 25% of their body weight in addition to other morbidity factors are subjected to euthanasia in accordance with our animal health care facility protocols at the University of Alberta.

Even at the highest doses of scHPXV tested, there may be no overt signs of illness in Balb/c mice. The VACV strains most closely related to scHPXV, old South American viruses, in some cases produced no disease at $10^7$ PFU (Medaglia ML, Moussatche N, Nitsche A, Dabrowski PW, Li Y, Damon I K, et al. Genomic Analysis, Phenotype, and Virulence of the Historical Brazilian Smallpox Vaccine Strain IOC: Implications for the Origins and Evolutionary Relationships of Vaccinia Virus. Journal of Virology. 2015; 89(23):11909-25). It is impractical to test much higher doses than this due to the difficulty of making purified stocks with titers in excess of $10^9$ PFU/mL.

Example 10. Determination of Whether scHPXV Confers Immune Protection Against a Lethal VACV-WR Challenge Mice that appear to have been unaffected by the initial virus administration described in Example 9 continue to gain weight normally throughout the experiment. Thirty days post virus inoculation, mice are subsequently challenged with a lethal dose of VACV-WR ($10^6$ PFU/dose) via intranasal inoculation. Mice are closely monitored for signs of infection as described above. Mice are weighed daily and mice that lose greater than 25% of their body weight in addition to other morbidity factors are subjected to euthanasia. We expect that mice inoculated with PBS prior to administration of a lethal dose of VACV-WR show signs of significant weight loss and other morbidity factors within 7-10 days post inoculation. Approximately 14 days post lethal challenge with VACV-WR all mice are euthanized and blood is collected to confirm the presence of VACV-specific neutralizing antibodies in the serum by standard plaque reduction assays.

Figure 6:
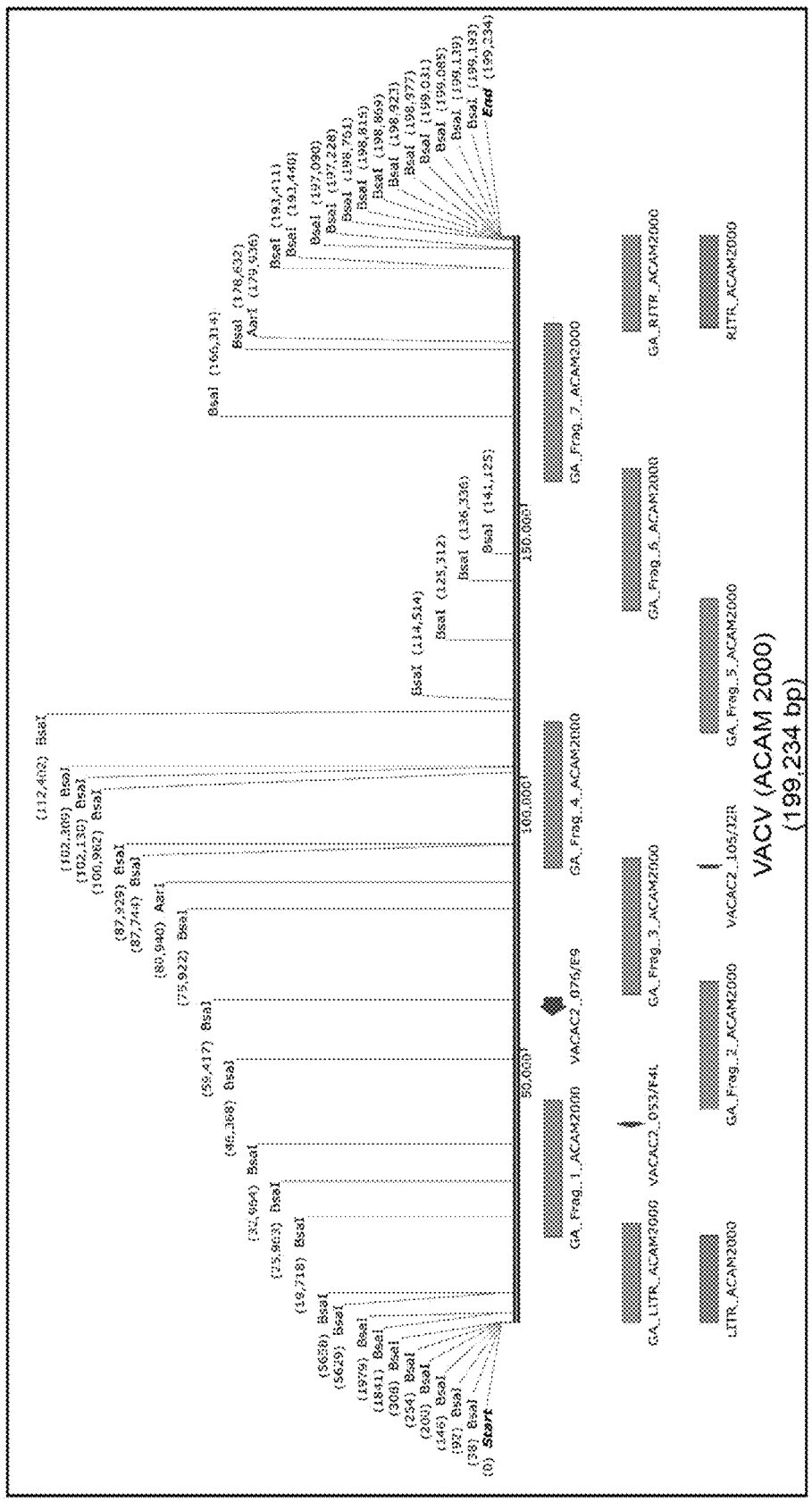

Example 11. Construction of a Synthetic Chimeric VACV (Strain ACAM2000) (scACAM2000) using SFV-Catalyzed Recombination and Reactivation Reactions Design of overlapping fragments of the VACV (ACAM2000) genome Using the published sequence of the VACV genome (strain ACAM2000; Genbank Accession AY313847), the genome is divided into 9 overlapping fragments (FIG. 6) that range in size from 15,979 bp to 28,795 bp in length (Table 7). These fragments are designed so that they share at least 1.0 kbp of overlapping sequence homology with each adjacent fragment to provide sites where homologous recombination can drive the assembly of full-length genomes (Table 7). These overlaps should be sufficient to support accurate and efficient recombination between the co-transfected fragments.

In order to successfully synthesize and subclone these large fragments, each BsaI and AarI site in VACV_ACAM2000 fragments 1 to 7 are silently mutated. As with the creation of scHPXV, the BsaI restriction sites in the two ITR-encoding fragments are not mutated, in case there are DNA sequence features that were important for efficient DNA replication and concatamer resolution.

For the initial reactivation, the thymidine kinase in VACV (ACAM2000) is replaced with the yfp/gpt cassette to help recover newly reactivated VACV particles.

TABLE 7

The VACV ACAM2000 genome fragments used in this study. The size, location within the VACV ACAM2000 genome [GenBank Accession AY313847], and overlap with adjacent fragments are described.

| Fragment Name | Size (bp) | Location (bp) | Overlap with adjacent fragment (bp) |
|---|---|---|---|
| GA_LITR (A2000) (SEQ ID NO: 50) | 18,073 | 1-18,073 | — <br> Frag_1 (2287) |
| GA_Frag_1 (A2000) (SEQ ID NO: 51) | 24,895 | 15,787-40,681 | LITR (2287) <br> Frag_2 (1342) |
| GA_Frag_2 (A2000) (SEQ ID NO: 52) | 23,297 | 39,340-62,636 | Frag_1 (1342) <br> Frag_3 (2453) |
| GA_Frag_3 (A2000) (SEQ ID NO: 53) | 24,971 | 60,184-85,154 | Frag_2 (2453) <br> Frag_4 (1604) |
| GA_Frag_4 (A2000) (SEQ ID NO: 54) | 26,575 | 83,551-110,125 | Frag_3 (1604) <br> Frag_5 (1896) |
| GA_Frag_5 (A2000) (SEQ ID NO: 55) | 24,635 | 108,230-132,864 | Frag_4 (1896) <br> Frag_6 (2129) |
| GA_Frag_6 (A2000) (SEQ ID NO: 56) | 25,934 | 130,736-156,669 | Frag_5 (2129) <br> Frag_7 (2183) |
| GA_Frag_7 (A2000) (SEQ ID NO: 57) | 28,801 | 154,487-183,287 | Frag_6 (2183) <br> RITR (1403) |
| GA_RITR (A2000) (SEQ ID NO: 58) | 17,350 | 181,885-199,234 | Frag_7 (1403) <br> — |

Ligation of the S and F Forms of the Terminal Loops (from VACV Strain ACAM2000) onto the Left and Right Ends of the VACV ITRs To prepare the VACV ITR fragments to be transfected into SFV-infected cells, the terminal hairpin loops are ligated to the left and right ITR fragments using the same methods used to attach VACV hairpins to the HIPXV telomeres described. Briefly, through DNA synthesis a 5' overhang comprised of three nucleotides is left at the end of each hairpin (5'-ACA; as described in Examples 1 and 2). Meanwhile, the plasmid clones encoding the left and right VACV ITR fragments are designed to encode a SapI recognition site located immediately adjacent to the first nucleotide encoding the start of the VACV genome. Digesting the ITR clone with SapI creates a three base overhang (5'-TGT), complementary to the 5'-ACA overhang in the terminal hairpin loop structure. The left or right ITR fragments is mixed with a ~20-fold molar excess of the terminal loops and ligated. This produces a hairpin-terminated copy of each ITR.

Leporipoxvirus-Catalyzed Recombination and Reactivation of scACAM2000

Following digestion and DNA clean up of the VACV genomic DNA fragments, they are transfected into SFV-infected BGMK cells. As described previously, the SFV helper virus will catalyze the recombination between fragments sharing flanking homologous sequences, resulting in the creation of full-length VACV genomes that can be packaged and released from the cell. It is unlikely that hybrid viruses will be produced in this assay. After 4 days, the BGMK cells are harvested and reactivated VACV virus particles are released by freeze-thaw, followed by plating on the susceptible BSC-40 cells. The reactivated VACV (ACAM2000) plaques are the only viruses to form plaques on BSC-40 cells. Plaques are picked to produce clonal virus stocks followed by isolation of genomic DNA to be sequenced by nextGen ILLUMINA© sequencing to confirm the integrity of the recovered viruses and identify whether scACAM2000 is successfully reactivated.

Example 12. Safety and Immunogenicity of scHPXV in a Small Animal Model

Materials and Methods

Murine intranasal model of scHPXV infection. Six-to-eight week old BALB/c mice are purchased from Charles River Laboratories. Groups of five mice are intranasally infected (or mock infected) with $5\times10^3$ PFU VACV (strain WR), $1\times10^7$ VACV (Dryvax DPP15), or $1\times10^5$ PFU, $1\times10^6$ PFU, or $1\times10^7$ PFU of scHPXV YFP-gpt::095 (described in Examples 1-6) or scHPXV (wt) (described in Examples 7 and 8) in 10 µl of PBS. The mice are weighed daily for 28 days, and the following clinical signs are scored: ruffled fur, difficulty breathing, reduced mobility, and pox lesions. Mice that lose 25% of the initial weight are euthanized. These vaccinated mice are subsequently challenged intranasally with $1\times10^6$ PFU VACV (strain WR), weighed and monitored daily for clinical signs of disease as described above for 13 days. Mice that lose 25% of the initial weight are euthanized as per protocols approved by the local animal care and use committee.

Figure 7:
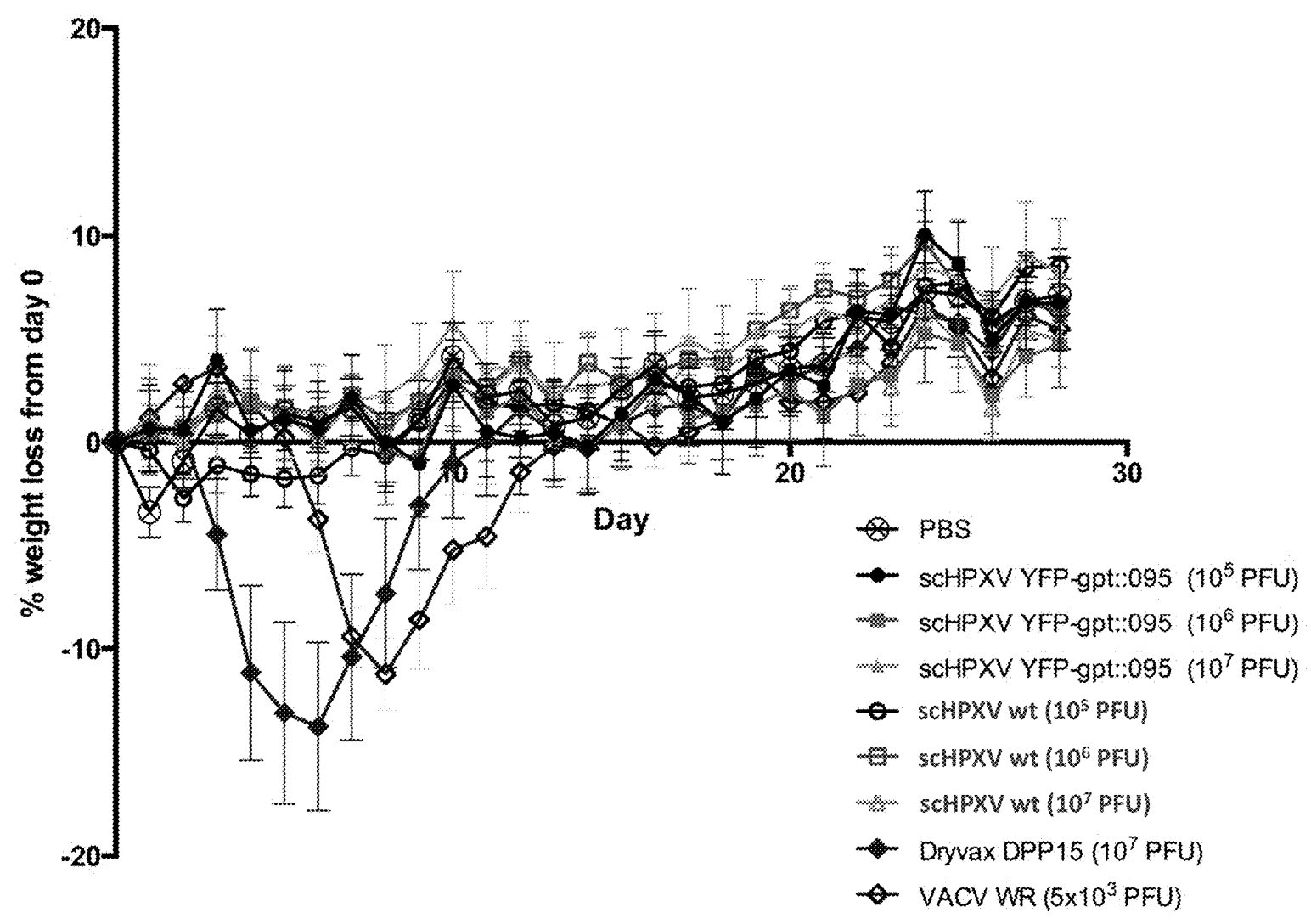
Figure 8A:
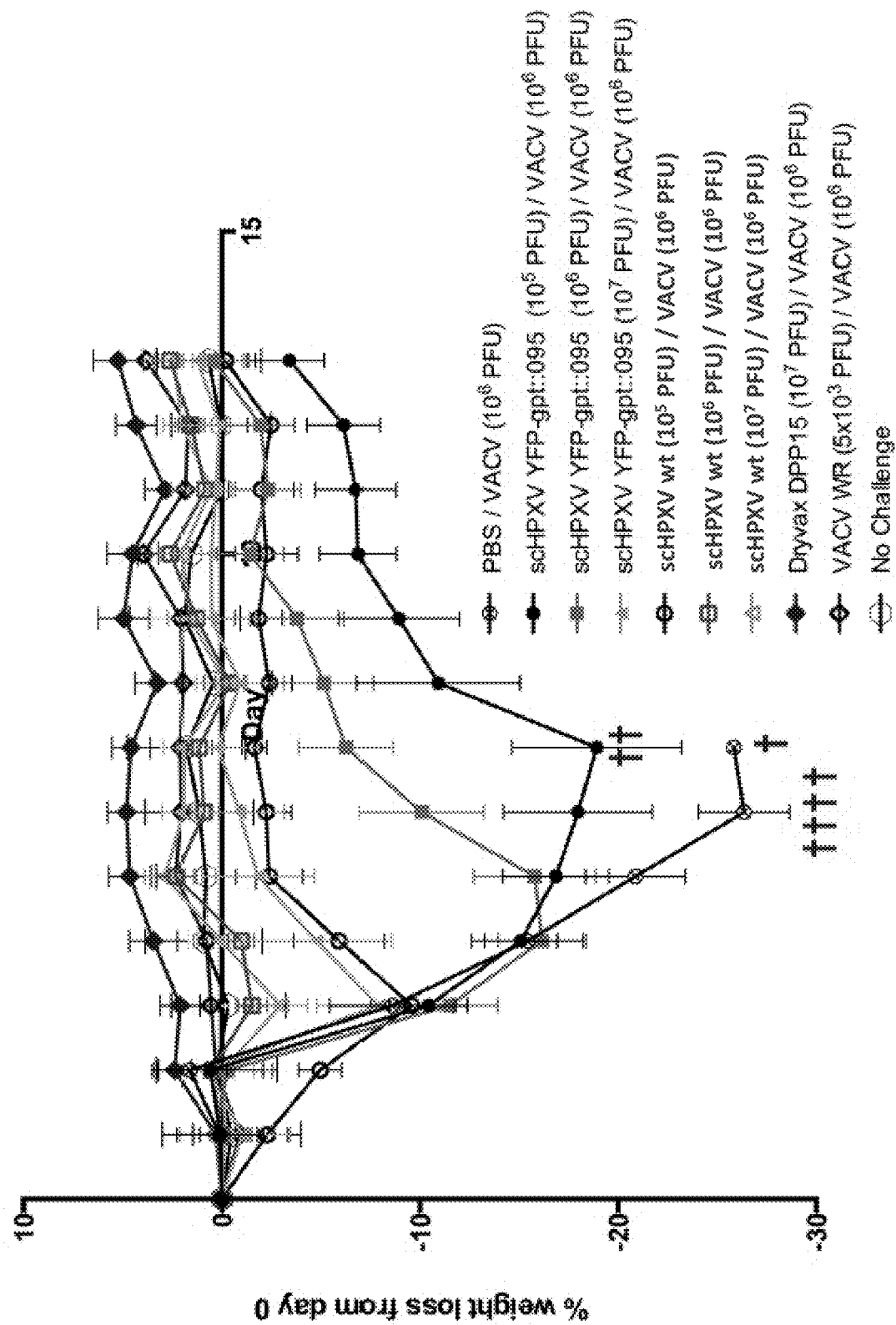
Figure 9:
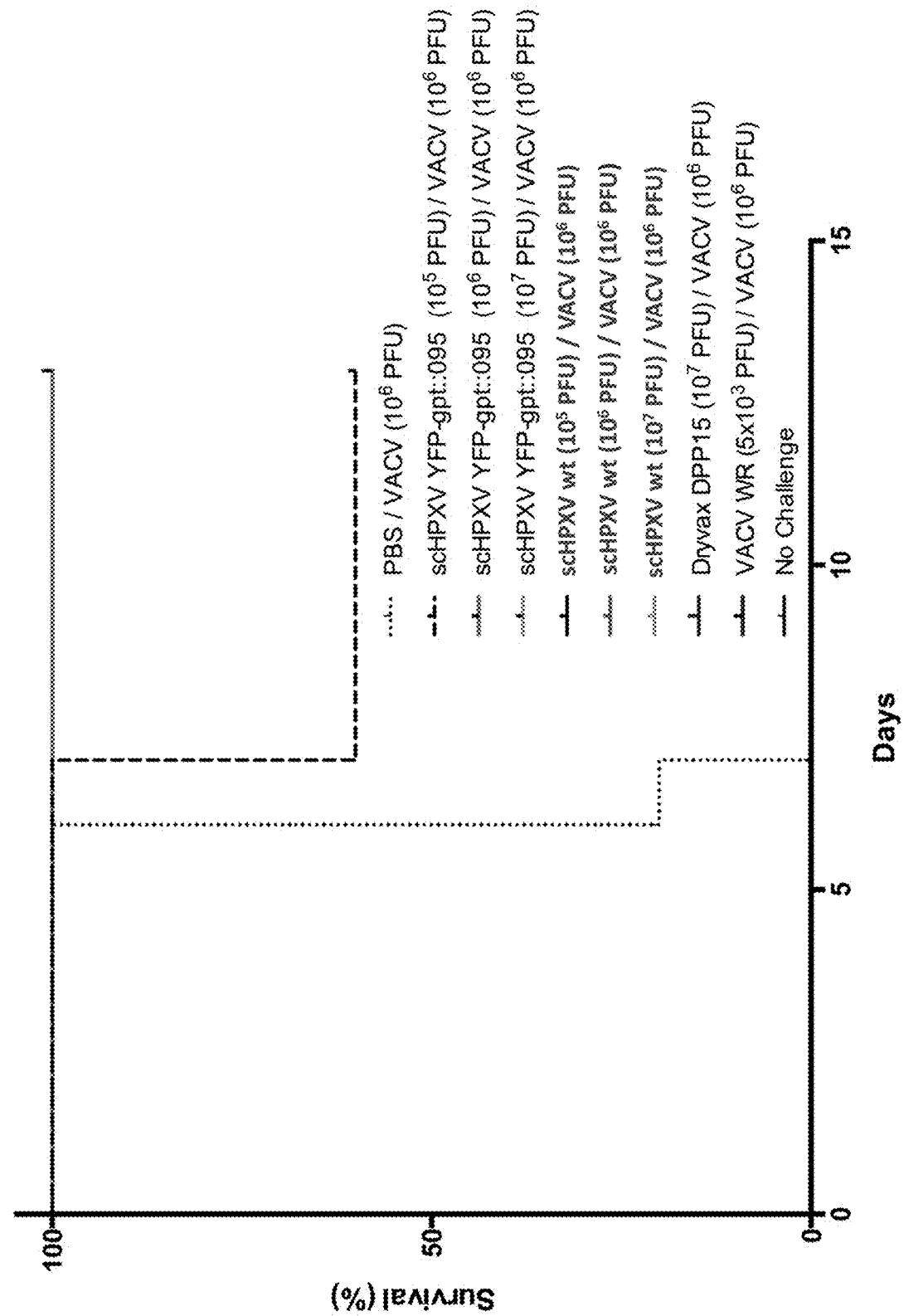
FIG. 9 shows survival curves of mice who are challenged intranasally with a lethal dose of VACV WR ($10^6$ PFU) . . . t indicate the number of mice that succumb to the VACV infection on the indicated day.

Results scHPXV Strains do not Cause Weight Loss in an Intranasal Murine Model of Poxvirus Infection The toxicity effects of scHPXV YFP-gpt::095 or scHPXV (wt) are examined in an intranasal murine model of poxvirus infection. Mice are inoculated intranasally with the indicated dose(s) of scHPXV (wt) and their weights are monitored over a 28-day period. No weight loss is apparent in mice inoculated with any of the doses of scHPXV YFP-gpt::095 or scHPXV (wt) over the 28-day period (FIG. 7). This is in contrast to animals inoculated with either Dryvax DPP15 ($10^7$ PFU) or VACV WR ($5\times10^3$ PFU), who lose an average of 15% and 10% of their initial weight, respectively. These data suggest that even at the highest dose of scHPXV (wt) and scHPXV YFP-gpt::095 tested ($10^7$ PFU), no adverse effects are observed. With a known smallpox vaccine strain, DPP15, however, transient weight loss is detected in mice by ~7 days post inoculation, although these mice return to their initial weight by ~10 days post inoculation.

scHPXV YFP-gpt::095 ($10^6$ & 107 PFU) and scHPXV (wt) ($10^5$, $10^6$, $10^7$ PFU) Confer Immune Protection Against a Lethal VACV WR Challenge in Balb/C Mice Following the 28-day immunization of BALB/c mice with the indicated strains of scHPXV YFP-gpt::095, scHPXV (wt), DPP15, and VACV WR (FIG. 7), mice are subsequently challenged with a lethal intranasal dose of VACV WR ($10^6$ PFU) to assess the protective efficacy of scHPXV (wt) or scHPXV YFP-gpt::095 in mice. All of the mice initially treated with PBS succumb to infection whereas the animals initially exposed to $10^7$ PFU of Dryvax (DPP15) or $5\times10^3$ PFU VACV WR show no weight loss (FIG. 8A) and no signs of illness (FIG. 8B). Animals vaccinated with the two lower doses of the scHPXV YFP-gpt::095 show weight loss (FIG. 8A) and signs of severe illness based on clinical scores (FIG. 8B) and two animals in the lowest scHPXV YFP-gpt::095 doses also are observed to succumb to infection (FIG. 9). The remaining animals in these low-dose groups of scHPXV YFP-gpt::095 are observed ultimately to recover from the infection, but their weights remain lower than the average weights in the rest of the groups. Animals previously exposed to $10^5$ to $10^7$ PFU of scHPXV (wt) show only minor transient weight loss in the first few days following poxvirus challenge (FIG. 8A), and no clinical signs of illness (FIG. 8B). These data show that scHPXV can infect and immunize mice against a lethal VACV challenge and can do so without causing disease during the initial immunization step.

SEQUENCE LISTING (62 sequences)

SEQ ID NO: 1 - DNA, 10095 bp, Horsepox virus
tgtgtgaccaacgaccgtaggaaactctagagggtaagaaaaatcaatcgctttatagagaccatcagaaagaggtttaatatttttgtgagaccatcgaaggagaaagagataaaacttttttacgactccatcagaaagaggtttaatatttttcttagtacaaaagttaatgttttaaaatatatggatgagaatatttgtctgtataaaaacttgtgtgaaattttgtaccaaagaaaaaacgtgagcagtatcccctatatggattttactagatcatttatatgccaaaaaatattatactatatacgtttattatatgatgttaacgtgtaaattataaacattattttatgatgcaattgtctagtaacctagatgggcatagggatattgataatctctacgagaatatattgttggacgttatcgtttacgaaatagttgaaacatcagaaagaggtttaatatttttatgagaccattgaagagagaaagagaataaaaatatttttgtaaaactttttttatgagaccatcgaagagagaataggaataggaatagtgatcatatcgtatcacatattgagacagaaaaagaagaagtaacgagatgtaactttttgtgaatgtagttaagaacatttttgttttgcaaaccggaatatagtgtccggtacacttttttaattcgtggtgtgcctgaatcgttcgattaaccctacttatccaatttcagatgaatagagttatcaattcagacacacgctttgagttttgttgaatcgatgagtgaagtattatcggttgcacctttagatgccgatccgtcgacatacttaaatccatccttgacctcaagttcagatgattccttgcacatgtctccgatacgaacactaaactctagatttttgacgcattttgtatcgacgatcgttgaaccgatgatatcttcgtaactcactttcttatgagagatgttagacccgagtactggatgggtcttgatgtcgctgtctttctctttttcgctacatctgatgttgatagacacctcacagtctttgatcatagccagagcttcttcacgagtgatcgcgggagagtccttaccttgtcctggggacacactggacaatctagcattcaccgtgtttccgtcagaggattcagagatggataaaatctttgggcattttgtgaatccaaagttcatgttaagacccgcaccaacgatactgtaataagtggtgggatctctttttacaacttcttcggatacctcatcgtctttggtctctgtaacttccgttacggattgacaaatcttatcatcggtcggtgtttggtcttgctttgtgactttgataataacatcaattcccatatgatgtttgttttcttcttccgtacacgaggatgaggatgaaaatgattgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatattgcaactaccgggcatatggctatcgacatcgagaacattacccacatgataagagattgtatcagtttcgtagtcttgagtattggtattactatatagtatatagatgtcgacgctagatagacagtcgcccactagagttacagtctccaaatgcggcatgataccgtcatcattctttgctttcgttaactgtttggaggaaaaatttttgttattgcatttaatctcgaaattcagagtgcacacctttgaaatattttgatatctattttctcctgtaaagaaacctgaagttgctaccttattaaggacagagaagtattcctcacgaaatacgggattacagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggaaaacagatgacgtctccggtagacgtgtgtccggatactccgtatcctattccacattttgtttgggaaacacatgccttgcatccggatgatcctttgagaagacaataatatccgggagagcattcacagattctattgtgagtagtgttacacgatcgcgtctctacctgattactatcgcatcttccgttacaacttagacaagcgggtaaatgattattgcgagatgtgaaggtacccgaaccacacggcgtacattgtgtgttagtcttgctatcgcataatctggaagcgtatgttcccggaggacacgataaacaacacaaattatggcgtttgtattcgttgtctttacactttccattggatggtgcatgcggtgctatatctcttccgtttattattatacatgagagaaacaatatatacaagtataatacggacttcataatttaataatgtagtaatcgttgtcttgttcttgtttcctacttctccaattatatagatattttttaaatattttctttctatcatggataatatttgtaatggttctttccgtacaacatactgtttagatgatagtcgcttagcttggttatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatgtcttctgttcttaataccgtatacaggtcggtgtcggagattcgaatctctttaaggcgacttatgtcacgactgcatttttcgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtaaaacaacgatttaatcataggtagagatactttcagtctgtggtggatgatgtcattcacaacatccgccttgtatatgatgtttctgttttcaaacaccaagtcgaataccgtcttatcgtctttagtcggaaggttgatgtcgtatccgatgtatacgaggtatgaggcaacattgttgttacaattttgaaaggcggtatgaagaggagtcatggtattatagtattcgtctttctgaatgtcgaacctatttagtagataccgtagtatattgagagtgtaacttccgtatccttgattatgttttatgaatagataaagtagatgttgtccttcttccttttgtaatttcccgtatttttgttcgtgccaattgagtaacattatgagaatatgacctgttgcacaatcgttctttatgtattccatgatgggtgtacaatcaagattattacgtatcctcgtatcggctcctcgagataaaagagcatacaccacacgaggactatgtttggtatactgttgaaggtaagtgtgtaacggcgtatttccgatttttgtaaccgcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttagtcaataatttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttaccacattttagtcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatttcatccatctcataatgatttactttttcataattaaagatgtgaaagaaaaagaaaaccgaacaatatattttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctcgagttgtatctccatgggtaatttcgaaatcaagttatcgtctgtattaatgttgtccactatggagtcgatcctctcattgttctttacagtttctgtaatgatggacgttagttcttttttgtaccatttgatgttggatacaaagtttataaatgtcggattctttgcgtatctcaatctgtggcgtttgcttcgtttaaataatatatcaaacatggagacgcctgatatgtaggcattcttcattctattaatgtctactctatagcgctttagttccttatgatgaccggcgatatcatacttactttagaaggaaaatcatcatctatgattaaggcgtatctgatacatgccgataatggttcaggatatagatagcgtatatctctattaaatgcgtcaatcatagtctctagagtgggatggtagctaagtaataaatcaactatcctcgttttgttttctctttggtaactgcttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgagaggatagttgttgtccgttgtcttatccatggtcgctccgttatctaacatgcatcgaacgataggtatacttaccatatcgccgtaatgtaagtagtttatcaacatggcttgtacgatggattcatcctgttgtctaaatctctttagaatgttatcaatgatgtagtggttatattctctggaatcgtacgaagtaatactacgcattacgtcgacaagagtatgacgtctctcaataagaagattaacgatttccatgtctacattatatggggttactctaaatcgcttgtttagataatccgctaatacgcctctaatatagggctgactgacgtcgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagactattgtttgcataattcgtattcttggacggacgtatccgtttatccacaattaggtattttagcagacgtaagtcgatattatccgaagacatatacgaatacagatcgaaatcatttatattcgacttgagtttgttagaggaattcgaatagctggatatcagtagatgcacaatttgagatttgacgtatctatgcttactgtatactcctagcggagttaatccttcgttgtttctacaaagtctctcgactccgcgagagagtaacagccgaacaatcttaatgtctgtatcgcatttattgaagacgtaacaatgtagcgcattgtttcctcgtctatctatatgttttgataagttgtgacacgtttcaatttctagttttattttttcgtacgtcacatcttcatccagtagacgacatagaatacatgtgcaatctctgacgcaatccatagctattctggtgctaattattcctatattatatttcacgaaaaatgatgaaggcaatcattcctcataagatgataaaaagtaaggtgggtgtgataaaaagtgtagtgagtgagtgagtgagaaagtaagagtattagtgagagagcatgaaggagatttagtatttagcagtgcggatatgatccaagagggtgagatagtcgttttcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccgagaactccttcaactcaccaccaaagagctccgttgcatcagttctgaaagagatgagaagcctgtagagagaccctgcgctttctctatgggtccatctatgagaaacccacaggatgtattcagtcagacaatgtctgacgtcggccacggtatacagggagtccttagtagcgtggcaatgacagggtctgaactgggcacaaggaaaggccattgtaaaggtagacgaaggttaacctgatggtagacctgtagccgtctatgctaatagagggctttaatttccatttttttaatgggttgtggatgaggaatgagagtgtcttatttcgtccttggtttacatggatcagagtgagaaaaaaatatcttgtatattattaactaacaaccttggtttccaaatagcttaagaaggcatttacacataatggagatatattccagcagaaaactggataaccgtccaaagtattatttgatatagtagtttttgatataatagacgcgaccccaatagcagtttttgtaaattgaacagggtctatactatgagtaacgtctgatttctgtttaagtttcgtatacaagtcaatgttatagacataatccatatcagagttagagtcataaatatcttttagtacagtaacgcgcatatcatgtataaatggttccccatacgtttcaattgctaagtcctcataagtcgtaaactctttgaatattggtcccatatcatcaatgtttagattatgtacaattctcaaatacgctttgacaagattataaaaccctcttacttgagttttagctacgataactgaaaatggcatatatttgataaactcctaaaagaataattttgtcagggctccatctctcatcaagttacatgtatttgtaataacgtcatttacagtactatttttttgtaaatctaaatttttaatgattctattaacttcttgattattcatggccttaatagcattggatattttatcatccatgtttaaaaaataacctatatgttaatacttgatattgatattaataattagtataattactatgtattatatttcattattatgaggaggatttatgtcatatcatgaaattaataagagaactagattaaagtaatagtaataggaataggaataggaattacttttcgtttgtctcactattataaaaagatgttatatctcaatcactgctataaagatccatcatatactatgatactgtatcagtttctatcaatctctgttttgggtgaattcaaaaaaaattaataatacctagaaaatattccatgagcatttcttttatcgatatagcatttggatagcctgtcaatatcgacatcattgaacaacggattcatcttacacttttcacgaacatcctgagatacattgttccatcttataacccgaattagatcattgtcttcagggaacttagttagccaatcaagaataatatcaatgacctcatcttctttgacatctagatagtcgcagtttatgatattaaacatagaatctgctgatatcaattgtttgaatctaacatccttatacaatgtttcaatctcattagcaatgttttcctcaatcatagtcatgacattgtatttatcctccatttccttatatctattgctaaacaactcatacatctcaagagcgtttctttcatctatcatataatgaaagatacgaactgttgcatggcccaagatctcagaatcaaggaagcgagcaagatcaaacatttcaactacatcttccaactcaagattatccatgactcctgtgtatatgaaatcaatggccatctcgataacaaaacctgaataatcaatattgaagattttttgatctggatcattacttagcatctcagcaaagtatgtagaaaatccagatacagccaccttatgtgcgataatgtcgttgttatcttttgtgtggaatgttatatcacaaaactttccagattttctaagattattcatattgctagctagatcatatctatgtttcacacacaattctttctcatgttcgttaaggtcgtacccacgaacaaaatagtaatcactcattctgacgacagcataaacagtaactaatttttctatctttagagagtatctccctattacctcattatgataatgtgtaaatagatacttcttaataatgtatagatgctgtctataaaaaaatcattcatgggtttgtgtttggacgcttttcatagactgtagtaagtggtcaatattacatcctatgtaatcaatagcagggttagttgcataatatttcatatacaagtcacgcacgatagctatctatctaattaattgttctagtcgcacacatatttggaggtatatagctaatatcgattatgtttcctatatgaatagtagcagtatcctcttcaaatccctcattggtattgacatacgcgatagagatggagatctgatagacagttgcctattaaagtgaaattttcagcgtgtgttgatgctttttcaggaacgcgtgtaaaattaccgattaatacaggttccgtttcagcgttacattttacttttatattcagcgtacacatcttggatgtattttgtttttttgtagtatctgtaaaaagtcctgctatagcagttttaccctttacagagtaatattctgttacaaagactggattgcaatctgttctattaacagtaattgtcaatttagaagtcgtgataacatctgatgattgttttgtacttagtcgattacaagatgatacgttaactggatatagttcaaaatctagagaaatgtagttaaatgtagttaaatgtatctgtaatgtatttgtcttcaaagaaaccgggtgtaggataatcattt

SEQ ID NO: 2 - DNA, 16257 bp, Horsepox virus
attaataatacctagaaaatattccatgagcatttcttttatcgatatagcatttggatagcctgtcaatatcgacatcattgaacaacggattcatcttacacttttcacgaacatcctgagatacattgttccatcttataacccgaattagatcattgtcttcagggaacttagttagccaatcaagaataatatcaatgacctcatcttctttgacatctagatagtcgcagtttatgatattaaacatagaatctgctgatatcaattgtttgaatctaacatccttatacaatgtttcaatctcattagcaatgttttcctcaatcatagtcatgacattgtatttatcctccatttccttatatctattgctaaacaactcatacatctcaagagcgtttctttcatctatcatataatgaaagatacgaactgttgcatggcccaagatctcagaatcaaggaagcgagcaagatcaaacatttcaactacatcttccaactcaagattatccatgactcctgtgtatatgaaatcaatggccatctcgataacaaaacctgaataatcaatattgaagattttttgatctggatcattacttagcatctcagcaaagtatgtagaaaatccagatacagccaccttatgtgcgataatgtcgttgttatcttttgtgtggaatgttatatcacaaaactttccagattttctaagattattcatattgctagctagatcatatctatgtttcacacacaattctttctcatgttcgttaaggtcgtacccacgaacaaaatagtaatcactcattctgacgacagcataaacagtaactaatttttctatctttagagagtatctccctattacctcattatgataatgtgtaaatagatacttcttaataatgtatagatgctgtctataaaaaaatcattcatgggtttgtgtttggacgcttttcatagactgtagtaagtggtcaatattacatcctatgtaatcaatagcagggttagttgcataatatttcatatacaagtcacgcacgatagctatctatctaattaattgttctagtcgcacacatatttggaggtatatagctaatatcgattatgtttcctatatgaatagtagcagtatcctcttcaaatccctcattggtattgacatacgcgatagagatggagatctgatagacagttgcctattaaagtgaaattttcagcgtgtgttgatgctttttcaggaacgcgtgtaaaattaccgattaatacaggttccgtttcagcgttacattttacttttatattcagcgtacacatcttggatgtattttgtttttttgtagtatctgtaaaaagtcctgctatagcagttttaccctttacagagtaatattctgttacaaagactggattgcaatctgttctattaacagtaattgtcaatttagaagtcgtgataacatctgatgattgttttgtacttagtcgattacaagatgatacgttaactggatatagttcaaaatctagagaaatgtagttaaatgtagttaaatgtatctgtaatgtatttgtcttcaaagaaaccgggtgtaggataatcatttgcaaacgatgtaacaaataataatgcgaatattagtattgtgtttatgtttatgtttatcatgatgagtatttatgataacaaagttttgtattatccggagtggtacagcattggtcggttggttctattttctttattgtggtatcaggagtacatctggcacaactattgactgcaggtaccgtacattttaatcctggaccacattgacattttcgtggtttattaggtccacatggttgtatctctaccatattgcttaaacaagtaacacacgccgtacataaaccatcttcaggttcaagatagtaatcattaggacacgttttaccaaatgatgtatatactaggcaggttacgatagcggataaaaagatagtattcatcttcatgctatttaatacatctaatatatgtattagttattaaaaaaatattattttatagaaactttgtgtgtgtatccagaacaattttatcttagtcactctttatctgtaagtcgagcattgataaatgtggcatgttgtctgttaattattatttttttaaaatacgttagtctaaatatcccgataatgcaactaaataaaagagtaacgggaatacgcataacgggatacatatccatgatatattttaatatgtcattggctatataatacatatatcgcgcatctgttatgtacgtattaattatatcatataatggatcattaccatgacaacacgctactagattgtgattttccctatatgcgattatgtcctctttgtaacatttaccaactagtatatcgtatatgctaatattagttctcgaattaatgtgtaactttgtcaacttatcgatgttatttctaatgctaactaacttatcaaatgccaaaaacattgcatgactattatcgagaatcgctatatccctctccatatactcgatgcatttattacagtaatccaatccagctaacataagagccaatctcaatgttggtttaatgatatcatgttcacataataataacgatggaaactttccactagtgtaacacttatctaagaatgatataaccatgtttacattaggtctcttatcgagaatattcttaacaagataccattggtggcccgacaacatattattttccatggttaacattagaggatctacaccattttttgttggtgtattaatattggcttgaatggataataagtaccacaaatgaatccatgacaatattggcattagtatgtgagataatagatacatgtaatggtgtcataccagatgttttacatactgcgttattatatctttctataatagcacaatgatatacgtcatgtatatttgtactatcgtacggctcatattcatcagtatataagttagtaggtatattatatttagcaacaatatgatgaataatgcatggagtgtcggctactctaattaatagatcctgaagtatgcgattttttaccatattcaatactttattagatatcaggcaatctattatgtcataatacatataattttgagcagtgcatatatatgaagttaatggagtataccctaaacaattgacggctgttatatcagcacccaaggatagcagacactgaataacatctcttatatcgttatcggtttttggatctaatatatgaacaacagacaacatagagagatatgtgtgtagtaccatattaccaatattgtcgggttcatttatatcattcccgtactcgtgtaaaagtttaatgatgctagtacttatgttgtgtcgcagaatatattgatgaagacaagtccttccagcactatctttataatgtagttttattcctggttgtaaaaaggagtaaacgactgatatatcgatattccgagctagtgttatatacgagtggagcatcataggtatattttttactttattgccatctagtgattctatatacaagtttgttatttttggattaatattatctatattggctatgtatatcataatcggactcattccattaacgcatttcatatccatatctccccaagttcgataatctttttaattacgtgtacacaaacatttcctgttatcatgtacgtgtgcaacggagtgataagatcacgattctgtaaatttacatttactccgttattgcataaccactctaatatatctatatcaacatccatgttgccgagatacgcgtgtaggataccgtatcctgttttcttgcatacataattaagatttacaattcctacatctaccatatatttagtcaagtctagttttatatggcgagttctcggtgaattgaaatacgtatatagaatatccatatctccattgttgggaatattaaacacatgattggtggttttacttttattatctttaataatacatttgacgaattttttatactgatcaaccaacgatttgttttttctatccgcttttagcattaaagtcatactaccgatgatattaatcaatgcggttttactatctgtatactgttcacgttgtctattatcaatacaataatatttctttttaaaaacttttatgcgtttagctctaactatgtgattataactgtatatatccccatcgctacagtatccatcatctggatcatcattatttatacgagcattagtgcttatacggttatcaaaatcttcaaagtatgtcgaatatatcagttttctgacattaactatagcgtgttcggttaatgatgctattttgataactataatcaaaaactgtcagtgtgttggtagtgcataaaaagtttatattattgttacattttttaaaaagatcaaggtataaaaattagaagtgttagattatattaattatactataaaaattagaagtgttagactattaactaacttataaaactatcttataaaactatcttataactattaactaacttataaaactatcttataactattaactcatttcaagaagggtgggtggagaaaactctatatgatagcttgtgaaacaattagatccctaatttctaatggaagttttgataggagattgtcatcagttgatacattgtttattatctcatctattagagcacgtctgtttagagctttagtgacatgctcgtttacttctgtgtaaatcttgaatcctttagtgatacactgtgtcaaaactggatgtttagaatacctatgtagaatatgggaagcatgcttgtttttgtccttattatagattaactcatacatggttgtattatgaattttcatctgcctaatgtactccaattcttgtttacaatcaattatataatcaaagagtgatgatgcatacacattacaaagtgaataatctaccatcataaaatacttgatacagagctttattacatcatggttttcaattgtattattaagtatagataattttatacagtcaatagacaatggttctctaagcaatatttctaatattttaagatgtgcttccctactggcgataacagatcccctatccacagccacgtcaagacatgtatatccatcactcattactgcgttgacatttgctccattttctaatagccatgatactaaatctatataacctgcatagatagcgcgataaagcaaggtccttccaccagcatctagttgattaatatcttcaatatatgggatacaaagcttacaaatttctaatactgtgggttcatctacaaggaatcccctagtatactgaattattttatataaatctaacttaacatcattttcatctgggataccacaatttaaaataaactcaacaacactactttcctttttacacattcccctaaaataggcattcaagcattctattttatatattacagccccatgatctaccataaaattaacaatgtctatttttacatatgcattagatagatagtaaagtaagagatcttgcacagaattacaattcttaataattataaagataatatcttccatataattctttgacactaatgcagatataatatctttatatgtaatatatgtaaacagtctatctactatatactgatcaatattatctctatgaatcctaaaataatcatacagaacatctacaggatcacaaattggttcaaggagaaatctatcaaatattttcctgtcaacaactggttctagaacataacagtcaacacccaatccatgttttacatagtcatctaccaaagataatgaccaaatgttgaggtcgtcgtgaaactgctcatcaacagccatgaaatctgccgactccatggtgcgaatcgcactgtcttattcgccattgattttcattttttataattatgtacatgatttccttctattctcaagagtctacaaaatatatattttttcgatatctaagtactaagttttttactgtttttgttactgtcccattcttctaactaaagatctgagataaattatacaatcttcgctatcaaaccatttttgtagtttaaagcctgaagtaattagccaactgtttttattagcggcttttttcgatctatcaatttcagtatattcttcgctgttataaaagtaatgttgtttaattgtaggacggttgttagtataatcacatgaataataatattctaattcctcgtattaactacttacagatactcgaaatagtctgaaaaattcttcaaagatatttttataaagatctaggaaaagtttattaccaaccatgaacgcgataaatggataaatatcctttccatcaaaggtcataattggataattgtccagcaatatatctgctgtattagttatatcacttccatttattttcagattgaagtaatgtactagtttgtgacaattaacaagagacaaaagagatgccgatactaatacgtaaatagctatacgcgaatccattgttacttttttatttcatacgtctattaataaatatatgtattacttaagactagaaaaatcaaaagtgagtttttgatatttgattcttacttattgtgggattgtagtttactaagtaattcatctctgaatcctgataaatcatgcatatcattgatacaactacgcagtaaactagtaggaatacaaatatctggatatgtacgtaaatagtcgattatatcttttacaatactattagtccctattgcgttatctatatatccattaataatattacacagtggatacttatcagaagtatacctcttacagatttctatacataaagtaatatcattattgtatgttttgcttattagtatcatatataaatatagtagaatagttgttaatatatgtagacattaataaactaatattatctcgaatatccactatcacgtctaaagtttgactcagtgatctataattagatgtattttgtgtttccaaatcatgttttatatgctcgataaatttgttacaattatttactcctatcaacataaatgcagaggccatcatttcatacaggctagtatttttagtactacataacgaaaataatgattcgtttttatagcatttatctaaaaatattataatattatctatagaaggtctgttatctagtaacatcttaactatatgacacttattatatcgatctctatgaaatattaacatcaatgcagaaataccctttatagttggtttatcgatactatatccaatagataataaatatttcattgcatctttgagtagacaaacggtggctacgtgaaacgcagtcattccagaaaatggtactatattcttatagtactttatcatttgacaatgatatgcatcattagtttcgtaatcacacttttcatattcatcggtgtatgagtctacaggaatattatatttagtaataacatgatgaattattggcagcgatatatcttctctagttattagatcttggattatacaatgctttaccatgtttaatactttatcagacatcagacaatctattatgtcgtgatacatataattttgtgcggtacatatgtaggacgttaatggggtataacctaaattattaaccaacgatatatctgatcctgaacgtataagatatttaacaacttttatgtttatattgttattgatactcgaatcatatgtcaaattttattaacgatacataaatctagaaagatatgtgtgtagtactgtattacctaaattatcagtctcgtttaaatagttgccgtgttcgagtaaaagtttaacgacatcgatatttatataatttcgtaacatatagctgtgaagacaagtttttccaacactatctttgtaatcaaggattgcactattattcagaaaatgttttatgacatctagatcaacatattgagccatttgtatatacagatacaatatctctggtatattagttatcttgttatcgtccatgtaaatctttataatttcttcgtctatattcatcgcattatatattatataagttattataggagttaactttatacaacatctgagattcctatcagcacctagttcaataactttctttaacacgcttgctgaaattaattcgtctctccgtaaatatgaatgtaatggagtaattagattattgttttgttcatttatattctttccacttttacataataattttagtacatctgtgtctacatacatattaccgagatatgtatgcaatataccaaatccatattcgtttttataattaatatctacgcctttagcaatcatccatttaaccaattttatgttgatgcctatcgtgttatgtgctttgaaatatacagagaatatgttactactatatttgtcactgttttcataatgactatctcgtcctcatcatcactatcatcactatcatcatccttcgttcttattatcatctttatcatcatccttattgtccttatcatcgtctattaaacacaaattatctacgtttataacaacattctcatcattaattagttctgtagtaatatctttaataatttggctatatatctgttcaatactatctattgatgatttctttttatgacttgaactaatgtaatgacgatgaaattgagtagtagcttttaataaagacttgatatcattatcatatgtttgatcgtcgtaattaatagtgtggctaatggtactgttaataagtttatagacaatatcatagtattttctttccagaactagattattttttaatactgatctaacatatatgtcgtaactatcatactggttctcacaattccgtgatgtagcagtagttgatgcatggtctatatcgttaaaatgtatcgtatataatagttttctgacgtggagtacagaattttcgattaatgagttcatggtaaggaagggcgaatgaatgcctgtatatatgcataagttaatagttttttatcatatttttctaatactatataaaaatatcattatgtataatcatcactgtcgctatcattattgtgtttgtgtagttctgtcctatcatctacatcactgctactgtcactctcgctatatcttctaaaattacaaacaactggatattcgataacagcatttgagtagtttttgtcttttacagtatatacgttattgtcaaaatctaaacaaatattagcataatacctatctataagatcaagatccatgttcgagcatactagtgcatatttgtaacttcgtcgtacagcgttagatcaataaataaacaatcttataacgcaactttttacgatctagttgtatgagtttatcgtttacataagctattaacggctttaacagatgatctgagtaatatacctctgttatacatttaatgttcacggtcttagtatttttagatatcaattgtaatttacacccatatttaactcccttgtgtaacgttagacattctaaatctatagtattatctattacagcgtaaaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccattaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaaatatgcgatgtatctatgttatttgtatttatctaaacaatacctctagctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcattttctgtgacggaagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagttattgatctattatatgaaacggatatgtctagaacagcaattgtcttacgtccagttaacactttctttgatttaaagtctagagtctttgcaaacataatatccttatccgactttatatttcctgtagggtggtataattttattttgcctccatatatcggtgtttccaaatatattactagacaatattccatatagttattagttaagggtacccaattagaacacgtacgcttattatcatcatttggatcgtatttcataaaagttattgtgttatcgatgttaacacattctacattttttaattgtctatatagtatttttttgatattttctataatatcagaattgtcttccatcgaaagttgtatactatcagaatcagttacatgtttaaataattctctgctgtcattccttatacaatcaaattcattattaaacagtttaatagtctgtaaacctttatcgtcgtaaatatccattgtcttattagttacgcttatttttatgtgtttttacgttgctttattatattttataagaatgattgtttgacgaatcacgagaactattaagacatatattattagaggtatatattataaaaaagtttttgattacgttgttataagaggagaggacacattaacatcatacatcaattaactacattcttataacatcgtaatcaaaagaattgcaattttaatgtataacaactgtcaatgggttatggaattgtatattacatattatacggtatgttggtaacgacaaataccgatcggtaatcgtttgccggtgtaataaaattatatatatctatctattacaccggctgagtatgcataataataagttgtgggtagtatcatccacatatttataatttaggactttgtattcagtatttttggaatcataaaaaaataaaaaagttttaccattttaaaatttaaaaagtatttacattttttcactgtttagttgcggatatggaatttgatcctaccaaaatcaatatatcatctatagatcatgtaacaatattacaatacatagatgaaccaaatgatataagactaacagtatgcattatccaaaatattaataacattaaatattatatcaatatcacaaaaataaatccacatttggctaatcaatttcgggcttggaaaaaacgtatcgccggaagggactatataactaacttatctaaagatacaggaatacaacaatcaaaacttactgaaactatacgtaactgtcaaaaaatagaaacatatatggtctatatatacactacaatttagttattaatgtggttattgattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtgaaatttgctatgaagttgtttactcaaaacgattagaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacaatgtacagtcatctataatcatggcatatttaatacattgttttatagcatagtagttatctacgatgttagatatttctctcaataaatcaatcacataatctaatgtaggtttatgacataatagcattttcagcagttcaatgtttttagattcgttgatggcaatggctatacatgtatatccgttatttgatctaatgttaacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccaacatgcattccactagagggatatcgatatcgccgaatgtcatatactcaattagtatatgttggaggacatccgagttcattgttttcaatatcaaaaagatggtttccttatcatttctccatagtggtacaatactacacattatttcgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcatcctcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttaaattggttcctggtatcattaggatctctgtctttcaacatctgtttaagttcatcaagagccacctcctcattttccaaatagttaaacattttgactgaatagaagtgaatgagctactgtgaactctatacacccacacaactaatgttattaaatatcattttttgaatgtatttataccatgtcaaaaacttgtacaattattaataaaaataatttagtgtttaaattttaccagttccagattttacacctccgttaatacctccattaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatataattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcaactaatatgaagtacttgatacatattttcagtaacgatttattattaccacctatgaataagtacctgtgatcgtctaggtaatcaactgtttttttaatacattcgatggttggtaatttactcagaataatttccaatatcttaatatataattctgctatt

SEQ ID NO: 3 - DNA, 16287 bp, Horsepox virus
aatgagctactgtgaactctatacacccacacaactaatgttattaaatatcattttttgaatgtatttataccatgtcaaaaacttgtacaattattaataaaaataatttagtgtttaaattttaccagttccagattttacacctccgttaatacctccattaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatataattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcaactaatatgaagtacttgatacatattttcagtaacgatttattattaccacctatgaataagtacctgtgatcgtctaggtaatcaactgtttttttaatacattcgatggttggtaatttactcagaataatttccaatatcttaatatataattctgctatttctggaatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaaactgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcataaccactatagttactatcgaataacgcgtcaaatatttcccgtttaatatcgcatttgtcaagataataatagagtgtggtatgttcacgataagtataataacgcatctcttttttgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttttattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtttatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtttagatctatagaatcaaaacacgataggtcagaagataatgaatatctgtacgcttctttttgtactgtaacttctggttttgttagatggttgcatcgtgctttaacgtcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcgtcgtggcaatttcctaagacgaaaataagacataaacacgcaataaatctaattgcggacatggttactccttaaaaaaatactaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaaaagttcgttctcatcatcagaataaatcaatatctctgtttttttgttatacagatgtattacagcctcatatattacgtaataaaacgtgtcatctaccttattaacttccaccgcatagttgtttgcaaatacggttaatcctttgacctcgtcaatttccgaccaatctgggcgtataataaatctgaactttaattgcttgtacccatttgaaataatttttaatcgacatccgtagttatcccctttatgtaactgtaaatttctcaacgcgatatctccattaataatgatgtcgaattcgtgttgtatacccatactgaattgatgaactaacgaatatcaacggcgttaatagtaatttactttttcatctttacatactgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaaaattatctatctacatcatcgtctattggataacgtctctgtattctacgatagagtgctactttaagatgcgacagatctgtgtcatcaaatatatactccattaaaatgattattacggcagcgaacttgatattggatacatcacgacctttgttaatatccacgacaatagacagcaatcccatggttccataaacagtgagtttatctttctttgaagcgatagtttgtagagatcttataaaaccgtcaaacgacatcgcatttatatctttagctaattcatatatgttaccatcgtaatatctacccgcgtctatcttaaacgtttccatcgctttaaagacgtttccaatagatggtctcatttcatcagtcatactgagccaacaaatgtaatcgtgtataatatctttgatagaatcagactctaaaaaaaaggaatcggctttattatacacattcatgataaacttaatgaaaaatgtttttcgttgtttaagttggatgaatagtatgtcttaataattgttattatttcattaattaatatttagtaacgagtacactctataaaaatgaaaatgacataactaatcataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacaactgaatctacatccaattttagaaattggtctgtgttacatatttcttctatattattgttgatgtattgtcgtagaaaactattacgtagaccattttctttataaaacgaatatatagtactccaattatctttaccgatatatttgcacacataatccattctctcaattactacatctttaagattttcgttgttaagatatttggctaaactatataattctattagatcatcaacagaatcagtatatatttttctagatacaaagacgaactctttggcgtcctctataatattcccagaaaagatattttcgtgttttagtttatcgagatctaatctgttcatatacgtatctatgattgtacggtacgttatgataaccgcataaaataaaaatccatttttatttttagctactattcataattgagattgatgtaatactttgttactttgaacgtaaagacagtacacggatccgtatctccaacaagcacgtagtaatcaaatttggtgttgttaaacttcgcaatatttatcaatttagatagaaacttatactcatcatctgttttaggaatccatgtattattaccactttccaacttatcattatcccaggctatgtttcgtccatcatcattgcgtagagtaaataattcttctgtattcggtagttcaaatatataatccatgcatagatcggtaaagctattgtagatgtgatttttcctaaatctaatataaaactcgtttactagcaaacattttcctgatttatcgaccaagacacatatggtttctaaatctatcaagtggtggggatccatagttatgacgcagtaacatagattattaccttcttaactgtcgctaatatctatatatttattgttatcgtattggattctgcatatagaacacataaccaatttatagtcgcgctttacattctcaaatctacagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttatataatatctctctgatataatcagatatatttattgtgtcggtagatgataccgttacatttgaattaatggtgttccattttacaacttttaacaagttgaccaattcatttttaatagtatcaaacgctccatgattaaatattttaatagtatccattttatatcactacggacacaaagtagctgacataaaccattgtataatttttatgttttatgcttattagcgtacacattttggaagttccggctgccatgtatttcctggagagcaagtagatgatgaggaaccagataggttatatccgtacttgcacttaaagtttacattgtcgttgtatgagtatgatcttttaaacccgctagacaagtatccgtttgatattgtaggatgtggacatttaacaatttgacacgtgggtggatcggaccattctcctcctgaacacaggacaccagagttaccaatcaacgaatatccactattgcaactataagttacaacgcttccatcggtataaaaatcctcgtatccgttatgtcttccgttggatatagatggagggaattggcatttaacagattcacaaataggtgcctcgggattccataccatagatccagtaaatcctaattcacaatacgatttagattctcctatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcattagttttcacactattcttaaatttcatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagttacgttacactttggagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgatgcgcctgaatatctaggagtaattaagtttggaagtcttatccattttgaagtgccgtgtttcaaatattctgctacacccgttgaaatagaaaattctaatcctcctattacatataactttccattgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagttataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcactgcagtaatattgttgattatttctgacatcgacgcattatatagttttttaattccatattgtttagaaaagttaaacatccttatacaatttgtggaattaatattatgaatcatagtttttacacatatatctactacaggcgtaacatcaattattacggcagcaactagtatcatttctacattgtttatggtgatgtttatcttcttccagcgtatatagtctaatagcgattcaaacgcgtgatagtttataccattcaatataatcacttcatcatttatatggtgctcctgaattcgtttaaaaaaattatacggagatgccgtaataatttccttattcacttgtataatttccccattgatagaaaacgtcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctattgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgattagacaaataaagaaaatcagatgatcgatgaataatacatttaaattcatcatctgtaagatttttgagatgtctcattaaaatattattagggtcagtactcattatcattaggcagctattacttattttatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagtaatttaactattttagttaacaactattttttatgttaaatcaattagtacaccgatatgtttaatacttattcatattttagtttttaggattgagaatcaatacaaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagttaggatgcataagtacaaagtacgcgataaacggaataataatatatttatctagtttatctttttttatcgcgttcatagttagatacatagtctcagaagtaggattatgtaacatcagcttcgataaaatgacggttatttagttttacacattcgctcatacatgtatgaccgttaactacagagtctacactaaaatgattgaacaatagatagtctaccattgtttcgtattcagatagtacagcgtagtacatagcatcttcacaaattatatcaatgtctaatagatatttgacgcattttatggatcccacttcaacagccatcttaaaatcggtaaaatcatattgctttcctttatcattaataatttctaaaacatcatctctatcataaaagatacaaatattaactgtttgatcagtaataacattgctagtcgatagcaatttgttaataagatgcgctgggctcaatgtcttaataagaagtgtaagaggactatctccgaatttgttttgtttattaacatctgttgatggaagtaaaagatctataatgtctacatacttgactgttttaaagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcaaatccgatggacattatttttttaaacactctttctgaaggatctgtacacgccaacaacagaccacatccttcttcatcaacctagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattaattttagaagctatatgcaatggataatttccatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggaataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgctatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcagacttgtattcaacatgcttttctataatcatcttagttattttagcatcatccaatagtacattttccagattaacagagtagatattaatgtcgtatttgaacagagcctgtagcatctcaatgtctttattatctatagccaatttaatgtcgggaatgaagagaagggaattgttagtgttggtaaatgccatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagtttcaccgtttgcatgttaccactatcaaccgcataatacaatgcggtgtttcctttgtcatcaaattgtgaatcatccattccactgaatagcaaaatctttactattttggtatcttctaatgtggctgcctgatgtaatggaaattcattctctagaagatttttcaatgctccagcgttcaacaacgtacatactagacgcacgttattatcagctattgcataatacaaggcactatgaccgttgatatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatataaacaatattaaggagattccaccttacccataaacaatataaatccagtaatatcatgtctgatgatgaacacaaatggtgtattaaattccagttcttcaggagatgatctcgccgtagctaccatgatagtagatgcctctgctacagttccttgttcgtcaacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattaaacataccggatctacgttctactatagaattaattttattaaccgcatctcgtctaaagtttaatctatataggccgaatctatgatattgttgataatacaacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttcattcccatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatatttaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgattttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacggtaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatcttgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatga

SEQ ID NO: 4 - DNA, 31946 bp, Horsepox virus
ttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacggtaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatcttgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggggggggtgttaatcttggaaattatttttctaaccttgttggtagcctttaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaactgttgctcccatggaatgacccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaattaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttctactggattcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtagacttgtcaaatctatataccatattttctggaagtggatatacatagtcgtgatcaacattattgctagcctcatcttctatatcatgtactataccattatctatatcctctatatcctgtactataccattatctatatcctctatatcctctatatcctgtactataccattatctatatcctctatatcatctacataatctacgatattattacacataaacatcgacaacatactattgtttattatctaagtcctgttgatccaaacccttgatctcctctatctgtactatctagagattgtacttctttcagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatcttcttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacaaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtaaaaccattaagcgcgaaagatgttattttgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtaccgcaaactcgatatatttaaacaagttaatgagatattaacgcgttttatgaatgatgatatataaccagaagttttatcctcggtggctagcgctataaccttatcattataataccaactagtgtaattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttatttttattcttattcttattcttagcgtcacagaatctaccacagcaggatcccatgacgagcgtcatattaaactaattcattttcaattataatatatgattagtaatgaccattaaaataaaaaatattcttcataaccggcaagaaagtgaaaagttcacattgaaactatgtcagtagtatacatcatgaaatgagatgaaatgatgatatatatatatatatactctattttggtggaggattatatgatataattcgtggataatcattcttaagacacatttctttattcgtaaatcttttcacgttaaatgagtgtccatattttgcaatttcttcatatgatggcggtgtacgtggacgaagctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattttccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatgaaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacaaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatgttgttaaaatataaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaacacctccacagtttttaatttctttagtaatgaaattattcacaatatcagtatcttctttatctaccagagattttactaacttgataaccttggctgtctcattcaatagggtagtgatatttgtatgtgtgatattgatatctttttgaattgtttcttttagaagtgattctttgatggtgtcagcatacgaattacaataatgcagaaactcagttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgatgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtaactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgttgccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtatttcattgtaaatttataggcggtgtatttaagttggtagattttcaattatgtattaatatagcaacagtagtttttgctcctccttgattctagcatcctcttcattattttcttctacgtacataagcatgtccaatacgttagacaacacaccaacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagttacaatcaccactttcatatttagaatatatatatgtaaaaatatagtagaatttcattttgtttttttctatgctataaatgaattctcattttgcatctgctcatactccgttttatattaataccaaagaaggaaaatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattattgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcttaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaaacataatactctgttggttttcttatatacaatattacgattttcttctttgaatggaataggtttttgaattagtttataattacaacataatagataaggaagtgtgcaaatagtacgcggaaaaaacataatagctcccctgtttttatccatggttttaagtaaatgatcactggcttctttagttaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttttatcttctaaaaaatcttcaacgtatggaatataataatctattttacctcttctgatatcattaatgatataatttttgacactatcttctgtcaattgattcttattcactatatctaagaaacggatagcgtccctaggacgaactacttccattaatatctctattatagcttctggacataattcatctattataccagaattaatgggaactattccgtatctatctaacatagttttaagaaagtcagaatctaagacttgatgttcatatattggttcatacatgaaatgatttctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgttgatatagattttagacattttagagagaactaacgcaatcagtaataaaactaatttattttatcattttttttattcatcatcctctggtggttcgtcgtttctatcgaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggtgtagtattcctacttttacagttaggacacggtgtattgtatttctcgtcaagaacgttaaaataatcgttgtaacttacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttttggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataattatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccaaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgttgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagataattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcatagccaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagcagtagagtatctaatggataaactgaaactaacaaagagcgatgtacaactgttgtgaatattttatgcttcgtaaaatgtaggttttgaaccaaacattctttcaaagaatgagatacataaaactttattatccaataaattgactatttcggatgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtcctttagacaacatttcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagttgttctaactctttcgctatttctatagacttatcgacatcttgactgtctatctctgtaaacacggagtcggtatctccatacacgctacgaaaacgaaatctgtaatctataggcaacgatgtttttacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactattttgtacgtatattgcatggaatcataaatggccttttcagttgaactggtagcctgttttagcatctttttatatctagctctctctgccaaaaatgttcttaatagtctaggaatggttccttctattgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgttaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatatacagcttcctttttgtctggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttctgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactattgctatagaggacaataatgtcatgtctagcaatgatctgaattatatttattattttttcatcagattatttaacaatttggcatctgatcccaaatacgcaatcaatgtgtcaaaggttaaacctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaataacgttgatggacaaataatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctttatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatgtcggagttaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttat

SEQ ID NO: 5 - DNA, 25566 bp, Horsepox virus
attaacgagttccatttatatcatccaatattattgaaataacgttgatggacaaataatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctttatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatgtcggagttaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagttgagatatatggacgcagatagctatatgatagccaactacagaaggcaaacgctataaaaaacataattacgacgagcatatttataaatatttttattcagcattacttgatatagtaatattaggcacagtcaaacattcaactactttcgatacattaactttctcattttctttaacaaattctgcaatatcttcgtaaaaagattcttgaaactttttagaatatctatcgactctagatgaaatagcgttcgtcaacatactatgttttgtatacataaaggcgcctattttaacagtttctagtgacaaaatgctagcgatcctaggatcctttaaaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatacgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcgtccagtttgccattctttgtaaagaaattattttctactagactattaataagactgataaggattcctccataattgcacaatccaaactttttcacaaaactagactttacgagatctacaggaatgcgtacttcaggttttttagcttgtgattttttcttttgcggacattttctagtgaccaactcatctaccatttcattgattttagcagtgaaataagctttcaatgcacgggcactgatactattgaaaacgagttgatcttcaaattccgccatttaagtttaccaaacaacttttaaatacaaatatatcaatagtagtagaataagaactataaaaaaaataataattaaccaataccaaccccaacaacctgtattattagttgatgtggtagttttctcatcacttagaacagatttaacaatttctataaagtctgtcagatctgtcaaatcatctttcggagaacccatatatacaccaaatatagcggcgtacaacttatccatttatacattaaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttctgttccggatctatagaagacgataggtgtgataattgccttggccaattgtctttctcttttactgagtgattctagttcaccttctatagatctgagaatggatgattctccagccgaaacatattctaccatggctccgtttaatttgttgatgaagatggattcatccttaaatgttttctctgtaatagtttccaccgaaagactatgcaaagaatttggaatgtgttccttgtgcttaatgtttccatagacagcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagatgaacaattagcgtattgagaagcatttagtgtgacgtattcgatacattttgcattagatttactaatcgattttgcatactctataacacccgcacaagtctgtagagaatcgctagatgctgtaggtcttggtgaagtttcaactctcttcttaattaccttactcatgattaaacctaaataattgtactttgtaatataatgatatatattttcactttatctcatttgaaaataaaaatgtttttgtttaaccgctgcatgatgtacagatttcggaatcacaaaccactggtggttttattttatccttgtccaatgtgaattgaatgggagcggatgcgggtttcgtacgtagatagtacatttccgtttttagaccgagactccatccgtaaaaatgcatactcgttagtttgaaataactcggatctgctatatggatattcatagattgactttgatcgatgaaggctcccctgtctgcagccatttttatgatcgtcttttgtgaaatttcccaaatagttttataaactcgcttaatatcttctggaaggtttgtattctaagtggatccaccatctgccataatcctattcttgatctcatcatttcataattttttctcggttaaaactctaaggagatgcggattaactacttgaaattctccagacaatactctccgagtgtaaatattactggtatatggtttcaccgactcattattttccaaaatttgagcagttgatgccgtcggcataggtgccaccaataaactatttctaagaccgtatgttttgattttatcttttagaggtttccaattccaaagatctgacggtacaacattccaaagatcatattgtagaataccgttactggcgtacgatcttacatatgattcataaggtccttccttttcagctagttcacaactcgcatctaatgcaccgtaggtttcgaagatcttcttatttagatcttgtgcttccaggctatcaaatggataatttaagagaataaacgcgtccgctaatccttgaacaccaataccgataggtctatgtctcttattagagatttcagcttttggaataggataataattaatatctataattttattgagatttctgacaattactttgaccacatcctttagtttgaaaaaatcaaattgtccatctattacaaacatgtttaacgcgacagatgccagattacaaacggctacctcattagcatctgcatattgtattatttcagtgcagaggttactacacttaatggttcctaaattttgttgattactctttttgttacacgcatccttataaagaatgaacggagtaccagtttcaatctgagattctataatcgctttccagacgactcgagccttcatatagtcttgtatctcttttctctttcgtattgtatataatcgttcgaactcgtctccccaaacattgtttaatccagaacattcatccaaacacatcaacgaccactctccgtcatccttcactcgtttcataaagagatcaggaatccaaagagctataaataaatctctggttctatgtttctcgtttcctgtattctttttaaaatcgaggaacgccataatatcagaatgccacggttccaagtatatggccataactcccggtcgtttgtttcctccctgatccatgtatctagcggtgttattataaactctcaacattggaataataccgtttgatataccattagtaccggagatatagcttccactggcacgaatattactaattgataaacctattccccctgccattttagagattaatgcgcatcgttttaacgtatcatagatgccctctatactatcatccatcatgttaagtaaaaaaacatctagacatttggtgacgactagttctcgcattaaataaggtaggagaagcgtgcgtaaaccatttttcagaaagtagattgtacgtctcaatagctaagtctatattccattgatgtatttttaccgcgacacgcattaacatgtgctgaggtttttcaacgatcttgttgtttatttttaacaagtaggatttttccaaagttttaaaaccaaaatagttgtatgaaaagtttcgttcgtaaataataaccgaattgagtttatccttatatttgttaactatatccatggtgatacttgaaataatcggagaatgtttcccatttttaggattaacatagttgaataaatccttcatcacttcactaaatagttttttgtttccttgtgtagatttgatacggctattctggcggctagaatggcataatccggatgttgtgtagtacaagtggctgctatttcggctaccagagtgttcaattctaccgttgttactccattatatattccttgaataaccttcatagctattttaataggatctatatgatccgtgtttaagccataacataattttctaatacgagacgtaattttatcaaacatgacattttccttgtatccatttcgtttaatgacaaacatttttgttggtgtaataaaaaaaattatttaacttttcattaatagggatttgacgtacgtagcgtacaaaatgattgttcctggtatatagataaagagtcctatatatttgaaaatcgttacggctcgattaaactttaatgattgcattgtgaatatatcattaggatttaactccttgactatcagggcggcaccagaaatcaccatcaaaagcattaatacagttatgcctatcgcagttagaacggttatagcatccaccatttatatctaaaaattagatcaaagaatatgtgacaaagtcctagttgtatattgagaattgacgaaacaatgtttcttacatattttttttttattagtaaccgacttaatagtaggaactggaaaactagacttgattattctataagtatagatacccttccagataatgttctctttgataaaagttccagaaaatgtagaattttttaaaaagttatcttttgctattaccaagattgtgtttagacgcttattattaatatgagtaatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaatttcttgacgctattggagttgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcgtcgtcgacgcccgtcaaccaaccgaacggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcaatgtcgcaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaaaacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgtttgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaaccggagtgggtaagacgtcacaggtacccaagttattgctttggtttaattatttatttggtggattctttactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacattagaggatgaccgagaacggctaaaagtatttttacctaatcccgcatttatacatattcctggaaatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgttcccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgcacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttaaagatgaaaaattttctacatctccttttgtagacacaactaaacattttgcagaaaaaagtttattattgtttagataatcgtatacttcatcagtgtagatagtaaatgtgaacaaataaaaggtattcttactcaatagattggtaaattccatagaatatattagtcctttcttcttgagatcccacatcatttcaaccagagacgttttatccaatgatttacctcgtactataccacatacaaaactagattttgcagtgacgttgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacaatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaaaaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattttcgaatccgaaattagaaattcccaagtagatatcctttttcatccgatcattgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagataaggaatcgttggagttagtgtcttccttatgtaggggatttgaaatatcttataatgacttaataacttactttccagataggaaataccataaatatatttctaaagtatttgaacatgtagatttatcggaggaattaagtatggaattccatgatacaactttgcgagatttagtttatcttagattgtacaagtattccaagtgtatacggccgtgttataaattaggagataatctaaaaggcatagttgttataaaggacagaaatatatatattagagaagcaaatgatgacttgatagaatatctcctcaaggaatacactcctcagatttatacatattctaatgagcgagttcccatagctggttcaaaattaattctttgtggattttctcaagttacatttatggcgtatacaacgtctcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatctgttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctaatacgtcgttaactttactaggtattccatatggatttggtcatgatagaatgtattgttttaaattggtagctgactgttataaaaatgccggtgttgaaacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggtggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctaatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactaatgagatgttattaaacgttgataaaatgcatgacgtgatagctcccgctaagcttttagaatatgtgcatataggaccactagcaaaagataaagaggataaagtaaagaaaagatatccagagtttagattagttaacacaggacccggtggtctttcagcattattaagacaatcgtataatggaaccgcacccaattgctgtcgcacttttaatcgtactcattattggaaaaaggatggaaagatatcagataagtatgaagagggtgcaatattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcagcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacaagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgactactaaggccactactcaaatagcacctaaacaagttgctggtacaggagttcagttttatatgattgttatcggtgttataatattggcagcgttgtttatgtactatgccaagcgtatgctgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgaggggttaatttcacaactttactgtttttgaactgttcaaaatatagcatcgatccatgagaaatacgtttagccgcctttaatagaggaaatcctaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaaccttatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttagagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgttattcctaaaaaaagtggtaggagaaagaataaaaacatggttatcttccgtcaaggatcatcacctatcttgtgcattttcgaaactcgtaaaaagattaatatttataaagaaaatatggaatccgcatcaactgagtatacacctatcggagacaacaaggctttgatatctaaatatgcgggaattaatatcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtattaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataagttaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagttgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaagaaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatcggctcctggtacacatatacgttatttgagagatcatttctataatttaggaatgattatcaaatggatgctaattgacggacgccatcatgatcctattctaaatggattgcgtgatgtgactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtatactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttatatcttatatcttatatcttatatcttatatct

SEQ ID NO: 6 - DNA, 28662 bp, Horsepox virus
atggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatcggctcctggtacacatatacgttatttgagagatcatttctataatttaggaatgattatcaaatggatgctaattgacggacgccatcatgatcctattctaaatggattgcgtgatgtgactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtatactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttatatcttatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcatcttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtataccttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagacggctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgattttgacggggatgaggaatggatgatattagaacaaaatcctaaagctgtaattgaacaaagtattcttatgtatccgacaacgttactcaaacacgatattcatggagcccctgtttatggatctattcaagatgaaatcgtagcagcgtattcattgtttaggatacaagatctttgtttagatgaagtattaaacatcttggggaaatatggaagaaagttcgatcctaaaggtaaatgtaaattcagcggtaaagatatctatacttacttgataggtgaaaagattaattatccgggtctcttaaaggatggtgagattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaaagatgtaagagacgggaaaatagttccattatctaaagctttagaagcggactacgtggaatccatgttatccaacttgacaaattttaatatcagagagatagaagaacatatgagacaaacgctgatagatgatccagataataacctcctgaaaatggccaaagcgggttataaagtaaatcctacagaactaatgtatattctaggtacgtatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgaaagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagtcgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggagaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagttaataaattcaagttcggtgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcagtaaacgcatgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaatttggtttcatgttttcaaagcggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatctcttttttctggcataacttcgttgtccttcacatcatcgaacttctgatcattaatatgctcatgaacattaggaaatgtttctgatggaggtctatcaataactggcacaacaataacaggagttttcgccgccgccatttagttattgaaattaatcatatacaactctctaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaagaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggataaagaaaaggaggaagtggaagaagaagtagttatagaggaatatcatcaaacaactgaaaaaaattctccacctccgttatcatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctataactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacaaaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattggatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaaaaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattttgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctatatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaacccgttattgtcaccgtattatcgtaatttagtagccagacaaatggtcaataatatgatttttaatcaagattcatttttaaaatatttattagaacatctgattagaagccactatagagtttctaaacatataacaatagttagatacaaggataccaaagaattaaatctaacgagaatatgttataatagagataagtttaaggcgtttgtattcgcttggtttaacggcgtttcggaaaatgaaaaggtactagatacgtataaaaaggtatctaatttgatataatgaatttggtgactgtatcacacgcaccatatactattacttatcataatgattgggaaccagttatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataaaatttctaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgtccttaagactataggtgtcccatcagcatgtagacaaaatgaagatccaagattcgtagaagcatttaaatgcgacgagttagaaagatatattgataataatccagaatgttcactatttgaaagtcttagggatgaggaagcatattctatagtcagaattttcatggatgtagatttagacgcgtatctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccacctcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagatttgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaattatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcaaacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaatccgttaatgtatatcttttagccgccgtatattccgatttcaatgacgaagtgatgtcattaaacgattacacacaggatgaattgattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatatgatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattgactatcttttgaaaatatacatttttatgatccaatacttgtaaaaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataggttattgcatggcgtgttttattaatcaatcgttgaaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgaacaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattgacgataggtgtagctgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagactgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatgg

SEQ ID NO: 7 - DNA, 30252 bp, Horsepox virus
ttagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagactgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaaaactgctttaggtgctgaaataaccacatctggaaggcttactcgcttagccatttaattacggaactatttttttatacttctaatgagcaagtagaaaacctctcatctacaaaaacgtactcgtgtccataatcctctaccatagtaacacgttttttagatctcatatgtgctaaaaagttttcccatactaattggttactattatttttcgtataatttttaacagtttgaggttttagatttttagttacagaagtgatatcgaatattttatccaaaaagaatgagtaattaattgtcttagaaggagtgttttcttggcaaaagaataccaagtgcttaaatatttctactacttcattaattttttcggtactcagattcagtttctcatcttttacttgattgattatttcaaaaactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctctgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacagacagcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtaatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctatcgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttactcttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttaagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttggtagtttgttgagcttgatcatttcctgcacgtttaggtttggtacgttgatttctagcccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggtgcatcagtatcttcagacagccaatcaaaaagattagacatatcagatgatgtattagtttgttgtcgtggttttggtgtaggaacagtactactaggtagaagaataggagccggtgtagctgttggaaccggctgtggagttatatgaatagttggttgtagcggttggataggctgtctgctggcgaccgtcatattatctctagctagttgttctcgcaactgtctttgataatacgactcttgagactttagtactatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgttggtaaacgattttgacaaagatggtctaaaattccatctagactatattatcaaaatttggaaacttcaaaaacgatattagaatttatacgaatatcgttctctaaatgtcacaatcaagtctctcatattcagcaggttattgtcgtactttatatcgtgttcattaacgatattttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctattgtgtctgttaatagacatccaacatcgacattcgacgtcaattgtctataaatcagagtataaattttagaaataacattagcaaattgttgtgcgttgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacataatctagtttattatataccgatttcacaacggcaccagatttaaggaaccagaatgaaaaactctgataactacaatatttcatcatagttacgattttattatcttctatagttggtgtaatagcgcatacctttttttccaagactggaaccaacgtcataaaaatgtttaaatcaaaatccatatcaacatctgatgcgctaagaccagtctcgcgttcaagattatttttactaatggtgacgaactcatcgtatagaactctaagtttgtccattatttatttacagatttagttgtttaatttatttgtgctcttccagagttgggatagtatttttctaacgtcagtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcagttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcatgtaaacattatgccgttatcattaataaagacttctttctcatcggatttgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaataatagatatttttttatccgaggatagtaaaatattattagtcgccgtctctataaaaataaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctatttgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcattaacgagttaaaaaagaccagttcattcaagataagcaaacgcgataaggatacgctattaaaatattttacttaggactagagttagaatttatagacgactcatttcgtttatcattattactattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgctattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttaactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcttttgtttagaacgattagctacagagttcaacgcttggctgactagcatattattatctttagaaattgtattcttcaatgaagcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatctacgtttggtaatggtaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacttgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacttttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagctatcgttaattatgcaaatttgaacgggtcccccttatcagttgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctaaaagatcgtgattgatctctccgaccattccacgaacttctaattggccgtctctaacggtaccataaactattttaccagcattagtaacagcttggacaatctgaccatccattgcgttgaatgatgtagttgctgttgttctacgtctaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccactaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcaccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacaaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtacacccaacgtatttacatctagttctttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctattgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaatttgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatatactgagaagttattatctgtagacgagcctagaaatcaacttattcttgataccctggtagaagaattcaagtcaggaactattaatcgaattttagttattactaaactacgtgaacatatggtatttttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaagaaagttatcggaaacatcaagaatccgattccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacttttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggatattacattttcttaccgctatattttggaagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaattaggaaaaaagatattagtaaaagatgtagaccatttaatacgatctaaggttagagaacatacatttgtaaaagtaaaaaagaaaaacacattttccattttatacgactatgatgggaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatagaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgaatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctagaagtgttggattttatccggatcaagtaaagatttcaaaaatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagttgcttctcttaatccaaatatgatatgtgattttgtaactgactttaaacgtagaaaacggatgggattcttcggtaacttggaggtaggtattactttagttagggatcacatgaatgaaattcgcattaatattggagcaggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggacaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcatttaaattcgaaattgtccgatgaagaattgtcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttaaaagactcagaagaggattatcaagatgtgtatatttgtgaaaattgtggagacatagcagcacaaatcaaaagtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggtcgttatttcgtcggacgtctgatattcggaaatctgtggagtttcaggttttggtggaggtgtaactgctacttgggatactgaagtctgatattcagaaagctgggggatgttctggttcgacatccaccgatggtgtcacatcactaatcggtttggtaacgtctgtggatggaggtgctacttctacagaacctgtagcctcagttgtcaacggagatacattttcaatgcaaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttccagatcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttcttttgaattcacagctggatgtacaaccgtttcctccgtttccattaccgccatctctaagtttcttttctagatcggcaatctttctcaacatttcatccccatgccttttacattcctcgagtctactgtcgtcgaaatatcgttccagctccttttcgacatcaataactttagcacgttgtctctcaagctctcttttgtagtaactatcatttttatctgattccctggcacgtttaagatcttcatgcaattgagtcagctcttaacacaatctcttaacttcctctcttgcttcttcgtcatagtacttacaatcactatgggatccattgttaccacgtctacactcggcgagctcgcgtttaagagattcaattttccgtttgtattggtccatgtctccattgctaccaccattagatttacaggctgctagttgtcgttcgagatcagaaatacgggttttcttgaattgatttcgtcgatgtacttggcatgattggcatcgaaacacttattaagttctttttccaattctacgattttatttctttcgcaagtcaattccctcctgtagtaactatctgttttgttagattcacgctctctacgtagactttcttgcaagttactaatttgttccctagcacgtccgagttcagttttatatgccgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattctagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcttactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgttatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcatttaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaagaatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaagaggaaatattcagtatatagatatgccttagcatcatatcttgtactaaacacgctaaacagtttattgatgtgatcaatttccaacagaataattagagcagcgggaataccaacaaacatattaccacatccgtattttctatgaatatcacatattatgttaaaaaatcttgatagaagagcgaatatctcgtctgacttaatgagacgtagttcagcagcagcataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcaaaactcaactcatcgttccatagtttttttacctcagtggcgaaatctttggagtgcttggtacatttttcaataaggttcgtgacctccat

SEQ ID NO: 8 - DNA, 30000 bp, Horsepox virus
ctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattctagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcttactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgttatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcatttaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaagaatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaagaggaaatattcagtatatagatatgccttagcatcatatcttgtactaaacacgctaaacagtttattgatgtgatcaatttccaacagaataattagagcagcgggaataccaacaaacatattaccacatccgtattttctatgaatatcacatattatgttaaaaaatcttgatagaagagcgaatatctcgtctgacttaatgagacgtagttcagcagcagcataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcaaaactcaactcatcgttccatagtttttttacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatggaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcaggatcgtatatataaggagtaccatcgtgattcttaccagatattatacaaaatactatatataaaatatattgaccaacgttagtaatcatataaatgtttaacgttttaaattttgtattcaatgatccattatcatacgctagcatggttttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttaaatatacttttaattgaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaattaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggttggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagctgatagcaattcatgtactacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagtttttaactagtaaagctgtaattacatactttgtccgtaaaacataaatataaacacccgcttttatcaaacgttccaaaaagtcgacagcggacatttttaacatggcatctattttaaatacacttaggtttttggaaaaaacatcattttataattgtaacaattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataataattataataattataattattataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatttcgatatttcaatcatggactttataggaccatacattatatgtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaaggtaaacatcagccattttatctattcccatctattgatgtttttaacgctacaatcatagaagcgtataacctgtatacagctggagattatcatctaatcatcaatccttcagataatctgaaaatgaaattgtcgtttaattcctcattctgcatatcagacggcaatggatggatcataattgatgggaaatgcaatagtaattttttattataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacatgaacacgatgatatagaatcatcggttgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtatttattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgatcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaatactgctacaaatgaaaaaaaagctattatcaaatactgtacggaatggattcattctcttctctttttatgaaactctgttgtatatctactgataaaactggaagcaaaaaatctgataaaaagaataaaaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgatggataaaacaaaaatgccccgcataactctatcatggcaataatacaaccaaacacttgtaaaattcctaaattagtagaaaatacaactgatatcgatgtataagcgatttcgaggaataataaaaacaaagtaatgcccgtaaagataaacatcaacattgtttggtaatcattaaaccaattagtatgacgttgaactaatttcacagtaaattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttgtccaatttccatctaatatactttgtcggattatctatagtacacggaataatgatggtattattacatgctgtatactctatagtctttgtagatgttataatcataaaagtacagaggtatatcaacaatattctaactcttaacatttttatttatttaaaatgatacctttgttatttattttattctattttgctaacggtatcgaatggcataagtttgaaacgagtgaaaaaataatttctacttacttaatagatgacgtattatacacgggtgttaatgggggggcagtatatacattttcaaataataaactaaacaaaactggtttagctaatactaattatatcacaacatctataaaagtagagaatgaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacaaaggtggtccatcatcgttgtctagtcatagatggtcgacgtttttcaaagtcgaattagaatgtgacatcgacggaagaagttatagacaaattattcattctaaaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgtttcacataccacgtttgacgttatagaacaatataatgtactagatgatattataaagcctttatctaaaccaacctatcttcgaaggaccgtctggcgttaaatggttcgatataaaggagaaggaaaatgaacatcgggaatatagaatatacttcataaaaaaaaattttatatattcattcgatacaaaaactaaacaaactcgcagtgcacaagtcaatgcacaactattttcagtaatggtaactgcgaaaccgttatttatagcagatatagggataggagtaggaatgccacgaatgaaaaaatacttaaaatgtaatcttaattcgagtacaccacacgacaatgaacaaacctaagacagattatgctggttatgcttgctgcgtaatatgcggtttaattgtcgaaattatttttacagcgacactattaaaagttgtagaacgtaaattagttcatacaccatcaatagataaaacgataaaagatgcatatattagagaagattgtcctactgactggataagctataataataaatgtatacatttatctactaatcaaaaaacctgggaggaaggacgtaatacatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaactaaacatatgaacggaactaaaaaacggaaatatatttgtagtacaacgaatactcccaaactgcattcgtgttacactatataacaattacactacatttttatcataacactacttcggttagatgttttagaaaaaaataaatattgccgtactgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcaccatatttatggattttggattcacacgttgtttgtctgaggggttcgtctagcgttgcttctacataaacttctattcccatatattctttattgtcagaatcgcataccgatttatcatcatacactgtttgaaaactaaatggtatacacatcaaaataacaaatactaacgagtacattctgcaatattgttatcgtaattggaaaattagtgttcgagtgagtcggattatgtgagtactggattgtatattttattttatattttatattttgtaataagaataaaatgctaatgtcaagtttattccaatagatgtcttattaaaaacatatataataaataacaatggctgaatggcataaaattatcgaggatatctcaaaaaataataagtttgaggatgccgccatcgttgattacaagactacaaagaatgttctagcggctattcctaacagaacatttgcaaagattaatccgggtgaagttattccgctcatcactaatcataatattctaaaacctcttattggtcagaaattttgtattgtatatactaactctctaatggacgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgaaatggataatatccatattgacgatgttaataatgccggtattggcatacagttcatcgatttttagatttcattcaaaggatgtggaattatgttatgggaatttgtattttgataggatctataataatgtagtaaatataaaatatattcctgagcatattccatatagatataattttattaatcgcgcgttctccgtagatgaactagacgataatgtcttttttacacatggttattttttaaaacacaaatatggttcacttaatcctagtttgattgtctcattatcaggaaacttaaaatataatgatatacaatgctcagtaaatgtattgtgtctcattaaaaatttggcaacgagtacatctactatattaacatctaaacacaaaacgtattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtggaagaaaaaaatattatcgatattgaagatgacgatgatatggatgtaaaaagcgcgtaatactatctataaacataagtatataataaatactttttatttacggtactcttgtagtggtgataccctactcaattatttttttaaaaaaatacttattctgattcttctagccatttccgtgttcgttcgaatgccacatcgacgttaaagataggggagtagttgaaatctagttctgcattgttggtacgcaccttaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctcttaccttatcaaagtcgtttatatcacattgtatatagtttataaccttaaccttcgaggttattggttgtggatcttctacaatatctatgactctgatttcttgaacatcatctgcactaattaaaagttttactatatacctgcctagaaatccggcaccaccagtaaccgcgtacacggccattgctgccactcataatatcaaactacttattctattttactaaataatggctgtttgtataatagaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataatttttttatagcgtgaaggatatgataaaaaatataattgttgtatttatcccattccaatcaccttatatgattctgtaaaaaaattatactgtaacacaatgaaggagtcttatagatgtatagaggtcagatactggtttgataaactgtttattccacataagtatgtttgactttatggttaaacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagcttatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccaatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgtagaagtactcggttccaaaatagcggatatagatattaaacaagtgatacgtgagaatatactacaattgtctaatgatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaattcatctaaacaaaatctagactttatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaaaaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaaggaagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatttaaacgatttagtaaacttgactaaatcttaatagttacatacaaactaaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagttaagaacgtttacatcgacggacaatctaaaaacaatacagtgattgcagatttgccatatctggataatgctgtatcggatgtatgcaaatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatttcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggctatagctactacgtttacggtatagcctctagataatttttttaagcacgaaataaaaaacataattttaaaccaatctattttatactattttgtgtaatcaccatggacataaagatagatattagtatttttggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcataaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagctattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccacacgctccggtaaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccgcaatcccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattatgattatgattttgattttgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatctataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgataaatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcaacgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgtcatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccatcaactactgtaggtagtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggtttaggaaagacagccatagccaaaagactgttaaaagactatgggaatatatttggatttgtggtgtcccataccactagatttcctcgtcctatggaacgagaaggtgtctattaccattacgttaacagagaggccatctgaaagggaatagccgccggaaactttctagaacatactgagtttttaggaaatatttacggaacttctaaaacagctgtgaatacagcggctattaataatcgtatttgtgtgatggatttaaacatcgacggtgttagaagttttaaaaatacttacctaatgccttactcggtgtatataagacctacctctcttaaaatggttgagaccaagcttcgttgtagaaacactgaagctaacgatgagattcatcgtcgtgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttattacgtgcaaggcatttggtctatacaaatccattaatgtggaatatagattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaacggcgaacatgttccatttataagaaatccaaataaaatggataacggtactctagaatttacacctatagattctcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcaactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgttgataaaaattaaaaaaataacttaatttattattgatctcgtgtgtacaaccaaaatcatggcgatgttttacgcacacgctctcggtgggtacgacgaaaatcttcatgcctttcctggaatatcatcgactgttgccaatgatgtcagaaaatattctgttgtgttagtttataataacaagtatgacattgtaaaagacaaatatatgtggtgttacagtcaggtgaacaagagatatattggagcactgttgcctatgtttgagtgcaatgaatatctacaaattggagatccgatccatgatcaagaaggaaatcaaatttctatcatcacataccgccacaaaaactactatgctctaagcggaatcgggtacgagagtctagacttgtgcttggaaggagtaaggattcatcatcacacacttgaagcaggaaacgctgtatatggaaaagttcaacatgattattctactatcaaagagaaggccaaagaaatgaatgcactcagttcaggacttatcatcgattaccacgtctggataggagattgtatctgtcaagttactgctgtagacgtacatggaaaggaaattatgagaatgagattcaaaaagggtgcggtgcttccgatcccaaatctggtaaaagttaaacttggggagaatgatacagaaaatctttcttctactatatcggcggcgccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaattaattgagagattggtagaggagttcttcaatagatcaaaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactggta

SEQ ID NO: 9 - DNA, 28754 bp, Horsepox virus
atggcgatgttttacgcacacgctctcggtgggtacgacgaaaatcttcatgcctttcctggaatatcatcgactgttgccaatgatgtcagaaaatattctgttgtgttagtttataataacaagtatgacattgtaaaagacaaatatatgtggtgttacagtcaggtgaacaagagatatattggagcactgttgcctatgtttgagtgcaatgaatatctacaaattggagatccgatccatgatcaagaaggaaatcaaatttctatcatcacataccgccacaaaaactactatgctctaagcggaatcgggtacgagagtctagacttgtgcttggaaggagtaaggattcatcatcacacacttgaagcaggaaacgctgtatatggaaaagttcaacatgattattctactatcaaagagaaggccaaagaaatgaatgcactcagttcaggacttatcatcgattaccacgtctggataggagattgtatctgtcaagttactgctgtagacgtacatggaaaggaaattatgagaatgagattcaaaaagggtgcggtgcttccgatcccaaatctggtaaaagttaaacttggggagaatgatacagaaaatctttcttctactatatcggcggcgccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaattaattgagagattggtagaggagttcttcaatagatcaaaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactggtagagaatgatatagaaaagcatatcaaaagactttgtgttgtgcatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtagttatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattgatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttattctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaatagattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactgtccacatatctaaaaatcttataaacattattaaaatataaaatctaagtggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgtgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgctttgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtctttttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacactcaatggtataatgatgaatgaacgcgatgtttctgtaagcgttggcaccggaatactattcatggaaatgtttttcgattacaataaaataattcaaaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaataacaataacagacaacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacaacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacaaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaattctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatacagatacagatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtgaaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatatttaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatcaactgctgaacagctatcgaaatatgtagaaaaggaggagaacatggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacagaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacaattgtattccacactcctctcttttagagatgatgcggaatcagtgttcatcgacattcgcgagctggtaaaaaatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctcccttcctccctcttctccctttcccagaaacaaactttttttacccactataaaataaaatgagtatactacctgttatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggacaccgacgtcttttggataagtaatggtatgtattacaaagaagatgatggggacggaaacggtagaataagtgtagcaaataaaatctatatgaccgataagagacgtgttattacatcccggttaaacattaatcctgttaaggaaaaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgttacatcctttattaaatcattaatgggaatttctatgtcatagttaatatattgtgaacaacaagagcagatatctataggaaagggtggaatgcgatacattgatctatgtagttttaaaacacacgcaaactttgaagaatttatataaatcattccatcaatacatccttctatgttgagatgtatatatccaggaattcgtttattaatatcgggaaatgtataaactaaaacattgcccggaagcggagcttctaccggagttatatcagtttttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaaccgaatcacctaccttagatacccaattacattttatcagatccagataataaacaaattttgtcgccctaactaattttatattgttatatattttacaattggttatgatatcatgtaataacttggaatctaacgcacatcgtcgtacgtttacacaattgtgatttagtgtagtatatctacacatgtatttttccgcgctatagtattctggactagtgataaaactatcgttatatctgtcttcgatgaactcatcgagatattgctctctgtcatatttatacacctgcataaactttctagacatcttacaatccgtgttattttaggatcatatttacatatttactggtataaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacatattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatattgtatccacctaccaaagtatagttgtatttttctcatgcgatgtgtgtaaaaaaactgatattatataaatattttagtgccgtataatgaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtattttatcgcacagatataaagactatgtggttaaatgggaaaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctatagaatgaatgaggatacgcgactatctaggtatttgtatctcactgatagagaacatataaatatagactctattaaacagttgtgtaaaatatcaaatcctaatgcatgttatagatgtggatgtacggctttacatgagtacttttataattatagatcagttaacggaaaatacaagtatagatacaacggttactatcaatattattcatctagcgattatgaaaattataatgaatattattatgatgattatgatagaactggtatgaacagtgagagtgagagcgagagtgataatatatcaatcaaaacagaatatgagaatgaatatgaattctatgatgaaacacaagatcaaagtacacaactagtaggttacgacattaaactcaaaaccaatgaggatgattttgtggatgaattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaatcaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcttaattacatgaagttattagtgtataacggaaatgatataaacgcacgaggtgaagatacacaaatgcgaactccattacacaaatatttgtgtaaatttgtatatcataatattgaatatggtgtccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatatcattaaagacagacgatggtaaaactgtatttgatttatcgttatgtagttacatccctcttaaatggactagctttttgattagtcgtctaccgcctaaaagtgtcatatgctcactgactaaccatataatagattatgttcttacgaacaatagacgtattatttggcagagtcaaatgattaataagtacgtactgttactggacccatccttttattctagatttagaaatgctatcgaaagcaaattaaaccaacacgctaatcgttataataggttcgaacacgatagagatcgcgttaatgaaaattatgacaaagtcttacatgacatagacatatatattaaggatgtacaaatattaaaatctatttccatcactaataatataacactatacgatactattataaataagtcagagtttcctatacgtcgtgcaaatgacaaacaattaattaataaaataaaatccaatatatatcataatcttatcgaaaaagttattaaaaatgcattagagaaatgcactctgactaatgccgtcctcgagtatatgatgtcatctcgatctcaatcatcttatttgagtcgtattcctaatgagatattactcgaaatattatataaactcgacatgtacgatttacgtaatctatatacaagatatatgagagagaatgatatcacagagtatcatatagagaatacgaggtctgtttctacacagacatgaataatgaatacacactacaacgtttttttttaaaatcttagatataacactaaaattacatcaagattataatattgaaatcgtaatttgagttgtttgataatcatggatatcaaaaatgatatacgtaacattagcaatcttttagatgatgatatattatgcgatgtaatcataactatcggagatggagaagaaattaaggcgcataaaactatcttggctgccggatctacgtattttaaaacaatgttcacgacacctatgatagcgagagatctagtaactagagtaaatctacagatgtttgataaagatgtcgttaaaaatattgtacagtacttatacaataggcatataagttctatgaatgtaatagacgtattaaaatgcgccgactatcttctaatcaatgatctagtcactaactgtgaatcctatattaaagattatattaatcatgatatataccataagttatatgagatggttcatattccaatagtcaaatatattaaacgtatgctgataagtaatataccaacattgataactacgaacgcatttaaaaaaacagtatttgaaatattattcgatattatttctactaacgacagtgtatatttatacagagaaggatataaagtgacgatactattgaagtggctagaatacaactacatcaccgaagaacagctgttgtgtatactgtcctgtatagatatacaaaatctagataaaaagtctagactactactctattcgaataaaactataaatatgcatccttcgtgtatacaatttctattagataataaacagaatagaaacattataccccaccagttatgtttagcgtgtcatgatactaactataatgtatgtaacccgtgtatagtagtgtataacattaatactatggaatatagtgttatttccaccattcctaatcacataattaattacgcatccgcaattgtagataatgacataataatagctagaggatataactttaataatccatcattaaacaaggtatataaaataaacattgagaacaaaatacatgtagaactcccacccataataaaaaatagatgtcgtttttcattggctgtaatcgatgacacaatttatgctataggtggtcaaaacggtacgaacgtagaacgaactatagaatgttatacaatgggtgatgataagtggaagatgttacccaatatgcccatagcattatctagttatggcatgtgtgtattagatcaatacatatacattataggcggtcgtacccaacacattgattatacatcagtgcatacagtaaatagcatagatatggaggaggatacaaatatttcaaataaagttatgagatacgacactgtcaataatatatgggaaacattacctaacttctggactggaactataaatccaggcgtggtctcgcataaagatgatatatatgttgtatgcgacatcaaagatgaaaaaaatgttaaaacttgtatatttagatataacacgaatacgtataacggatgggaattggtcacgacgacagaaagcagattatcagctctgcatactattctttataacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttatcgttatcgttatcgttatcgttattgtttggtctataccatggatatctttaaagaactaatcttaaaacacacggatgaaaatgttttgatttctccagtttctattttatctactttatctattctaaatcatggagcagctggttctacagctgaacaactatcaaaatatatagagaatatgaatgaaaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatagtacgaaggtctacataaaccatccatttatgtacatgattaaagacaacacaggacgtatactttttatagggaaatactgctatccgcaataaatataaacaaatagacttttatcacgtttatctatgtctaaatattacaaatagtaatagtataaactaaagctgataatacattaaaacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaatagatttccagatatggcttattatcgaggagactgtttaaaagccgtttatgtaacaatgacttataaaaatactaaaactggagagactgattacacgtacctctctaatgggggttgcctgcatactatcgtaatggggtcgatggttgattattgattagtatattccttattctttttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtatctacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtaactccatcaccaactccaacatatgcacatgtaacaactcctcttccaacatcagcagttccttatgatcaacgatcgaataacaatgtaagcactatatctattcaggtactgagtaaaatattgggagtcaatgaaacagaattaactaattatcttattacgcataaaaatgccacggttgacaataacaccatggtcaatgatgaaacatctgacaataacacattgcatggtaatataggatttttggaaataaataattgttacaatgtttctgtatcagatgctagttttagaataacattagtaaacgatacttctgaagaaattttgctaatgctaacaggaactagttcatccaacacctttatatcttccaccaatatcactaaatgtttgaaaacattaatcaataatgcgtcaattaatgatgtacttataacacaaaatatgaatgtaacatctaattgtgataaatgctcaatgaatttgatggcatccgttattcctgcagttaatgaatttaacaatacgttgatgaaaattggtgtaaaaaatgatgaaaacaatacggtatataaatattataattgtaaactaactacaaattctacgtgtgatgagttaatcaatttagatgaagtcattaacaacataactctaacaaatattatacgcaatagtgtttcaataactaacagcaggaaaagacgagatttgaatggtgagtttgaattttccacttccaaggaattagattgtctttacaaatcatatggtgtaaacgaggatgtaagtcattgttttgcatcacctagacgtaaacgatctgacgacaaaaaggagtacatggacatgaaattattcgaccacgcgaaaaaagatttaagaatagacagtgttattcctaaaggtacaactcatttccaagtaggtacatctggtgcaagtggtggtgttgtaggagataggtccccatttcaaaatgttaaatcacgtgcaagtctattggcggaaaaaataatgcctagagtacctactactgctaccgaagagcagctatatgcaactgtaaataaacaaaccaagttgcctgcaggtgttaaaagtactccgtttacagaggctcttgtgtctacgataaaccaaaagctttctagtgctaaagaggtaacttatgcttcgctcaatctgccaggatcaagtggctatgttcatagaccatctgattctgttatttacagcagtataagacggtcacgtttacctagtgatagtgatagtgattatgaagatatacaaactgttgttaaggaatataatgaaagatatggtagaccagtcagtaaaacacagttatcaagtagtgaaagtgattttgaagatatagatactgttgttagagaaattaaacaacaaaaatatggtggagctagccgtgttagaacatcatcaagtagtagtgattttgaagatatgaatactgttgttagggaatatagacaaaaatatggcaatgcaatggcaaaaggacgtagtagttcccctaaacctgatccattatatagtactgttaagaaaacaactaaaagtctatcaggtggtgtagacatagttacaaaacaatcagactattctctattacctgacgttaatactggtagttctattgtgtcacctctcaccagaaaaggagctactagacgccctacaaatgatggtctacagagtccaaatcctcctccccgtaatccccgtcgaccacttcctcaacatgatgattattctcctccacaagttcctcagcgcgattattctcctccgcgcagacctccgccacttcctcctaaaccagtccaaaatccgccacgacttccccctagaccagcaggtcaattacctcctatagatcaaccagataaaggatttagtaagtttgtatcacctagacggtgtagaagagcaagctctggagtcatatgtggtatgatacaatcaaaaccaaacgatgatacctatttacttcttcaacggccaaaacttgaaccagaatatgcggaggtcggtaatggtatacccaagaacaatgttcctgtaataggtaataaacatagtaaaaaatatacatcggcgatgttaaaaatatcaacaaaatttgataaatctacggcatttggagcagcaatgttactaactggtcagcaggccattagccaacagactagatcaactgcgttaagtagaaaagatcagatgagcaatgaagaaaagatattcgaagcagttacaatgagtctatcaactataggttcaacgttgacgtctgcgggtatggcgggcggtccaaaactaatgattgcaggaatggctataacggctataactggtataatagatacgataaaagatatatattacctgttttcaggacaggagaggccggcagatcctgttattaaattatttaatacatacgctggcttattatccgatagtaataaaatgggggtaagaaaatgtttgacgcccggtgacgacacacttatttatattgcatacagaaacgatagcagttttaaacatagtacggatgcgatggctttgtatttcttagatgttatcgactcagagatcctatatctaaacacatcaaatttagttctagagtatcaactaaaggtggcttgtcccataggaacattaagatctgtagatgtggacataactgcgtatacaatattatatgatacagcggataatattaagaaatacaagtttatcagaatggcaacgctactatccaaacatccagttattagattgacatgtggtttagcagcaacattggtaattaaaccgtacgaggtacccattagtgatatgcaactactaaaaatggcgacgcctggtgaaccagaatccactaggtctataccatctgatgtctgtgataggtatcctctaaagaaattctatcttttggctggtggttgtccctatgatacatctcaaacttttattgtacatactacttgcagtattctactaaaaacagctacacgtgatcagtttagaaacagatgggtgttacaaaatccatttagacaagaaggggaatataagcaactgtttacctttagcaaatacgattttaacgacaccataatcgatcctaatggtgtggcgggtcatgctagcttttgtaccaataaaagcagcaaccaatgtttctggtccgaacctatgatattggaagatgtatcatcgtgtagttctagaactagaaaaatatacgtaaaactgggaatatttaatgctgaaggttttaatagttttgtactaaactgtccaactgggtctacacctacatacatcaaacataaaaatgcggacagtgacaatgttatcatagagctacctgtaggtgattacggcacagccaaattgtattcagcaacaaaaccgtcgaggatagctgtgttttgcacacataactatgataaacgattcaaatcagatattatagttctaatgtttaataaaatcagcggtgttccattttggagcatgtacacaggaagtgtaactagtagaaatagaatgtttaccacattgtctagaggaatgccgtttagatcaacgtattgcgataacagacgacgatcaggttgttattatgcaggaataccatttcatgaagatagtgtagaagcagatctacattatggaccaaaaataatgttaaaggaaacatatgacacaaacagtattgacccacgagttataacaaagtcaaagacgcactttcctagtccaataagtgtaaaattcatggctgacaatttaggaaatggatatgacaaccctaattcattttgggaagatgctaaaactaagaaacggacatatagtgcaatgacgataaaagttctaccatgtacagtgagaaataaaaatatagactttggatataactatggagatattatttctaatatggtttatctacaatctactagtcaggattatggagatggtaccaaatatacatttaaatccgtaactagatcagatcatgagtgtgaatctagcttagatctgacgtctaaggaagtaactgtgacatgtcctgcgtttagtataccaagaaatatatcaacgtatgaaggtctatgctttagtgttactacatctaaagatcattgtgctacaagtaataatgggttaaaatcttctggctatggaaaggaagatgctgttaaaccacgtgcctgctttcatcattggaattattacacactgtcgttggattattactgttcatacgaagatatttggagaagcaactggcctgactatgatccatgtaagtcatatatccatatagagtatagagatacatggatagaatctaacgtgttacagcaacctccttacacatttgaattcactcatgacaattctaacgaatatgtggataaagaaattagtaacaaattaaatgatctgtacaatgcatacaagaagattatggaatatagcgacggatcattgccggcgtctataaacagattagcaaaagcattgacttcagagggtagagaaatagcaagtgttaatatagatggtaatctgttagatatcgcatatcaagcagataaggaaaagatggccgacatacagacaaaaataaatgacatcaccagagacttatttatgcacactctatcagacaaagatataaaagacattatagaatccgaagaaggtaagagatgttgtataatagatgttaagaacaatcgtgttgaaaagtactatcctattgataattatctatgtggtactttagatgattatatatacacctctgtagaatataacaaatcctatgtgttagtaaacgatacttatatgagctacgactatcttgaatcatcaggtatagttgttctatcatgttatgaaatgactataatctccttggatacaaaagacgccaaagatgctatagaagatgtgatagtagcaagtgcggtagccgaagcattgaatgacatgtttaaggaatttgataaaaacgtaagtgctattataataaaagaagaagataattatctaaacagttcgccggatatctaccatataatatatatcataggtggcactattctgctactgttagtcattattttaatattggcaatttatatagcgcgcaataaatacaaaaccaggaaatataaaataatgaaatatgacaataggagcattaaatctgagcatcatgatagtcttgaaacagtgtctatggaaattattgataatcggtactaataaaatagtttaactcttttaaaaccagtttggtactggaatttcagttcattactcgttgagaaattgatgatttttttaaaatgatattacttttatatgcttgcatcgcagaatgatattcacaagtattattaaaaatgagtatcggtagttacattaccatatcatccatgctcatatggatctccatccattatataatcaatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatactttaaatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacagtgatggtcacattccattacacaaatatttaactcatgatgaagttgagaatgatatctttgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgatattaataaagtaaataatataggaaatacacctctacataactacgtatctcaatatgatatcactctcattcctcatccacaacccattaaaaaaatggaaattaaagccctctattagc

SEQ ID NO: 10 - DNA, 8484 bp, Horsepox virus
taaaatagtttaactcttttaaaaccagtttggtactggaatttcagttcattactcgttgagaaattgatgatttttttaaaatgatattacttttatatgcttgcatcgcagaatgatattcacaagtattattaaaaatgagtatcggtagttacattaccatatcatccatgctcatatggatctccatccattatataatcaatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatactttaaatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacagtgatggtcacattccattacacaaatatttaactcatgatgaagttgagaatgatatctttgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgatattaataaagtaaataatataggaaatacacctctacataactacgtatctcaatatgatatcactctcattcctcatccacaacccattaaaaaaatggaaattaaagccctctattagcatagacggctacaggtctaccatcaggttaaccttcgtctacctttacaatggcctttccttgtgcccagttcagaccctgtcattgccacgctactaaggactccctgtataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggagttctcggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgaaaacgactatctcaccctcttggatcatatccgcactgctaaatactaaatctccttcatgctctctcactaatactcttactttctcactcactcactcactacactttttatcacacccaccttactttttatcatcttatgaggaatgattgccttcatcatttttcgtgaaatataatataggaataattagcaccagaatagctatggattgcgtcagagattgcacatgtattctatgtcgtctactggatgaagatgtgacgtacgaaaaaataaaactagaaattgaaacgtgtcacaacttatcaaaacatatagatagacgaggaaacaatgcgctacattgttacgtcttcaataaatgcgatacagacattaagattgttcggctgttactctctcgcggagtcgagagactttgtagaaacaacgaaggattaactccgctaggagtatacagtaagcatagatacgtcaaatctcaaattgtgcatctactgatatccagctattcgaattcctctaacaaactcaagtcgaatataaatgatttcgatctgtattcgtatatgtcttcggataatatcgacttacgtctgctaaaatacctaattgtggataaacggatacgtccgtccaagaatacgaattatgcaaacaatagtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgacgtcagtcagccctatattagaggcgtattagcggattatctaaacaagcgatttagagtaaccccatataatgtagacatggaaatcgttaatcttcttattgagagacgtcatactcttgtcgacgtaatgcgtagtattacttcgtacgattccagagaatataaccactacatcattgataacattctaaagagatttagacaacaggatgaatccatcgtacaagccatgttgataaactacttacattacggcgatatggtaagtatacctatcgttcgatgcatgttagataacggagcgaccatggataagacaacggacaacaactatcctctcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagcagttaccaaagagaaaacaaaacgaggatagttgatttattacttagctaccatcccactctagagactatgattgacgcatttaatagagatatacgctatctatatcctgaaccattatcggcatgtatcagatacgccttaatcatagatgatgattttccttctaaagtaagtatgatatcgccggtcatcataaggaactaaagcgctatagagtagacattaatagaatgaagaatgcctacatatcaggcgtctccatgtttgatatattatttaaacgaagcaaacgccacagattgagatacgcaaagaatccgacatttataaactttgtatccaacatcaaatggtacaaaaaagaactaacgtccatcattacagaaactgtaaagaacaatgagaggatcgactccatagtggacaacattaatacagacgataacttgatttcgaaattacccatggagatacaactcgagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaatatattgttcggttttctttttctttcacatctttaattatgaaaaagtaaatcattatgagatggatgaaatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgactaaaatgtggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaattattgactaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgcggttacaaaaatcggaaatacgccgttacacacttaccttcaacagtataccaaacatagtcctcgtgtggtgtatgctcttttatctcgaggagccgatacgaggatacgtaataatcttgattgtacacccatcatggaatacataaagaacgattgtgcaacaggtcatattctcataatgttactcaattggcacgaacaaaaatacgggaaattacaaaaggaagaaggacaacatctactttatctattcataaaacataatcaaggatacggaagttacactctcaatatactacggtatctactaaataggttcgacattcagaaagacgaatactataataccatgactcctcttcataccgcctttcaaaattgtaacaacaatgttgcctcatacctcgtatacatcggatacgacatcaaccttccgactaaagacgataagacggtattcgacttggtgtttgaaaacagaaacatcatatacaaggcggatgttgtgaatgacatcatccaccacagactgaaagtatctctacctatgattaaatcgttgttttacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgaaaaatgcagtcgtgacataagtcgccttaaagagattcgaatctccgacaccgacctgtatacggtattaagaacagaagacatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcataaccaagctaagcgactatcatctaaacagtatgttgtacggaaagaaccattacaaatattatccatgatagaaagaaaatatttaaaaaatatctatataattggagaagtaggaaacaagaacaagacaacgattactacattattaaattatgaagtccgtattatacttgtatatattgtttctctcatgtataataataaacggaagagatatagcaccgcatgcaccatccaatggaaagtgtaaagacaacgaatacaaacgccataatttgtgttgtttatcgtgtcctccgggaacatacgcttccagattatgcgatagcaagactaacacacaatgtacgccgtgtggttcgggtaccttcacatctcgcaataatcatttacccgcttgtctaagttgtaacggaagatgcgatagtaatcaggtagagacgcgatcgtgtaacactactcacaatagaatctgtgaatgctctcccggatattattgtcttctcaaaggatcatccggatgcaaggcatgtgtttcccaaacaaaatgtggaataggatacggagtatccggacacacgtctaccggagacgtcatctgttttccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgtaatcccgtatttcgtgaggaatacttctctgtccttaataaggtagcaacttcaggtttctttacaggagaaaatagatatcaaaatatttcaaaggtgtgcactctgaatttcgagattaaatgcaataacaaaaatttttcctccaaacagttaacgaaagcaaagaatgatgacggtatcatgccgcatttggagactgtaactctagtgggcgactgtctatctagcgtcgacatctatatactatatagtaataccaatactcaagactacgaaactgatacaatctcttatcatgtgggtaatgttctcgatgtcgatagccatatgcccggtagttgcaatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcaatcattttcatcctcatcctcgtgtacggaagaagaaaacaaacatcatatgggaattgatgttattatcaaagtcacaaagcaagaccaaacaccgaccgatgataagatttgtcaatccgtaacggaagttacagagaccaaagacgatgaggtatccgaagaagttgtaaaaagagatcccaccacttattacagtatcgttggtgcgggtcttaacatgaactttggattcacaaaatgcccaaagattttatccatctctgaatcctctgacggaaacacggtgaatgctagattgtccagtgtgtccccaggacaaggtaaggactctcccgcgatcactcgtgaagaagctctggctatgatcaaagactgtgaggtgtctatcaacatcagatgtagcgaaaaagagaaagacagcgacatcaagacccatccagtactcgggtctaacatctctcataagaaagtgagttacgaagatatcatcggttcaacgatcgtcgatacaaaatgcgtcaaaaatctagagtttagtgttcgtatcggagacatgtgcaaggaatcatctgaacttgaggtcaaggatggatttaagtatgtcgacggatcggcatctaaaggtgcaaccgataatacttcactcatcgattcaacaaaactcaaagcgtgtgtctgaattgataactctattcatctgaaattggataagtagggttaatcgaacgattcaggcacaccacgaattaaaaaagtgtaccggacactatattccggtttgcaaaacaaaaatgttcttaactacattcacaaaaagttacatctcgttacttcttctttttctgtctcaatatgtgatacgatatgatcactattcctattcctattctctcttcgatggtctcataaaaaaagttttacaaaaatatttttattctctttctctcttcaatggtctcataaaaatattaaacctctttctgatgtttcaactatttcgtaaacgataacgtccaacaatatattctcgtagagattatcaatatccctatgcccatctaggttactagacaattgcatcataaaataatgtttataatttacacgttaacatcatataataaacgtatatagtataatattttttggcatataaatgatctagtaaaatccatataggggatactgctcacgttttttctttggtacaaaatttcacacaagtttttatacagacaaatattctcatccatatattttaaaacattaacttttgtactaagaaaaatattaaacctctttctgatggagtcgtaaaaaagttttatctctttctccttcgatggtctcacaaaaatattaaacctctttctgatggtctctataaagcgattgatttttcttaccctctagagtttcctacggtcgttggtcacaca

SEQ ID NO: 11 - DNA, 156 bp, Vaccinia virus
acatttttttctagacactaaataaaaatttaaaatataatattaatgtactaaaactatatattattaatttatctaactaaagttagtaaattatatatataattttataattaatttaattttactatattttatttagtgtctagaaaaaaa

SEQ ID NO: 12 - DNA, 157 bp, Vaccinia virus
acatttttttctagacactaaataaaattagtaaaattaaattaattataaaattatatatataatttactaactttagttagataaattaataatatataagttttagtacattaatattatattttaaatattttatttagtgtctagaaaaaaa

SEQ ID NO: 13 - DNA, 27 bp, Artificial Sequence
  Description of Artificial Sequence: Synthetic primer
ctgtatacccatactgaattgatgaac

SEQ ID NO: 14 - DNA, 32 bp, Artificial Sequence
  Description of Artificial Sequence: Synthetic primer
gagttaatatagacgactttactaaagtcatg

SEQ ID NO: 15 - DNA, 32 bp, Artificial Sequence
  Description of Artificial Sequence: Synthetic primer
ggttctttttattcttttaaacagatcaatgg

SEQ ID NO: 16 - DNA, 25 bp, Artificial Sequence
  Description of Artificial Sequence: Synthetic primer
ttcttattaagacattgagcccagc

SEQ ID NO: 17 - DNA, 25 bp, Artificial Sequence
  Description of Artificial Sequence: Synthetic primer
agtcatcaatcatcattttttcacc

SEQ ID NO: 18 - DNA, 22 bp, Artificial Sequence
  Description of Artificial Sequence: Synthetic primer
atataacggacatttcaccacc

SEQ ID NO: 19 - DNA, 29 bp, Artificial Sequence
  Description of Artificial Sequence: Synthetic primer
gtaacatatacaacttttattatggcgtc

SEQ ID NO: 20 - DNA, 35 bp, Artificial Sequence
  Description of Artificial Sequence: Synthetic primer
ctaatccacaaaaaatagaatgtttagttattttg

SEQ ID NO: 21 - DNA, 23 bp, Artificial Sequence
  Description of Artificial Sequence: Synthetic primer
agtgactgtatcctcaaacatcc

SEQ ID NO: 22 - DNA, 28 bp, Artificial Sequence
  Description of Artificial Sequence: Synthetic primer
tttataaagggttaacctttgtcacatc

SEQ ID NO: 23 - DNA, 23 bp, Artificial Sequence
  Description of Artificial Sequence: Synthetic primer
ttgtgtagcgcttctttttagtc

SEQ ID NO: 24 - DNA, 23 bp, Artificial Sequence
  Description of Artificial Sequence: Synthetic primer
aaacggatccatggtagaatatg

SEQ ID NO: 25 - DNA, 25 bp, Artificial Sequence
  Description of Artificial Sequence: Synthetic primer
tatttgcatctgctgataatcatcc

SEQ ID NO: 26 - DNA, 26 bp, Artificial Sequence
  Description of Artificial Sequence: Synthetic primer
cgatggattcaaatgacttgttaatg

SEQ ID NO: 27 - DNA, 27 bp, Artificial Sequence
  Description of Artificial Sequence: Synthetic primer
atgcctttacagtggataaagttaaac

SEQ ID NO: 28 - DNA, 22 bp, Artificial Sequence
  Description of Artificial Sequence: Synthetic primer
ctggatccttagagtctggaag

SEQ ID NO: 29 - DNA, 26 bp, Artificial Sequence
  Description of Artificial Sequence: Synthetic primer
cggaaaatgaaaaggtactagatacg

SEQ ID NO: 30 - DNA, 29 bp, Artificial Sequence
  Description of Artificial Sequence: Synthetic primer
tgaatagccgttaaataatctatttcgtc

SEQ ID NO: 31 - DNA, 27 bp, Artificial Sequence
  Description of Artificial Sequence: Synthetic primer
tatggatacattgatagctatgaaacg

SEQ ID NO: 32 - DNA, 28 bp, Artificial Sequence
  Description of Artificial Sequence: Synthetic primer
aatacatctgttaaaattgtttgacccg

SEQ ID NO: 33 - DNA, 24 bp, Artificial Sequence
  Description of Artificial Sequence: Synthetic primer
cattttatttctagacgttgccag

SEQ ID NO: 34 - DNA, 20 bp, Artificial Sequence
  Description of Artificial Sequence: Synthetic primer
cgatatgaaacttcaggcgg

SEQ ID NO: 35 - DNA, 29 bp, Artificial Sequence
  Description of Artificial Sequence: Synthetic primer
acaaaacgatttaattacagagttttcag

SEQ ID NO: 36 - DNA, 19 bp, Artificial Sequence
  Description of Artificial Sequence: Synthetic primer
gtccggtatgagacgacag

SEQ ID NO: 37 - DNA, 25 bp, Artificial Sequence
  Description of Artificial Sequence: Synthetic primer
ttagggatcacatgaatgaaattcg

SEQ ID NO: 38 - DNA, 22 bp, Artificial Sequence
  Description of Artificial Sequence: Synthetic primer
tatggaagttccgtttcatccg

SEQ ID NO: 39 - DNA, 33 bp, Artificial Sequence
  Description of Artificial Sequence: Synthetic primer
gacttgataatcatatattaaacacattggatc

SEQ ID NO: 40 - DNA, 28 bp, Artificial Sequence
  Description of Artificial Sequence: Synthetic primer
agatctccagatttcataatatgatcac

SEQ ID NO: 41 - DNA, 30 bp, Artificial Sequence
  Description of Artificial Sequence: Synthetic primer
atgatacgtacaatgataatgatacagtac

SEQ ID NO: 42 - DNA, 29 bp, Artificial Sequence
  Description of Artificial Sequence: Synthetic primer
tgatttttgcaattgtcagttaacacaag

SEQ ID NO: 43 - DNA, 24 bp, Artificial Sequence
  Description of Artificial Sequence: Synthetic primer
tactgtacccactatgaataacgc

SEQ ID NO: 44 - DNA, 25 bp, Artificial Sequence
  Description of Artificial Sequence: Synthetic primer
gatatcaacatccactgaagaagac

SEQ ID NO: 45 - DNA, 27 bp, Artificial Sequence
  Description of Artificial Sequence: Synthetic primer
atcttaccatgtcctcaaataaatacg

SEQ ID NO: 46 - DNA, 24 bp, Artificial Sequence
  Description of Artificial Sequence: Synthetic primer
atagctctaggtatagtctgcaag

SEQ ID NO: 47 - DNA, 25 bp, Artificial Sequence
  Description of Artificial Sequence: Synthetic primer
gcgaactccattacacaaatatttg

SEQ ID NO: 48 - DNA, 28 bp, Artificial Sequence
  Description of Artificial Sequence: Synthetic primer
gatgtttctaaatataggttccgtaagc

SEQ ID NO: 49 - DNA, 212633 bp, Horsepox virus
tttattaaattttactatttatttagtgtctagaaaaaaatgtgtgaccaacgaccgtaggaaactctagagggtaagaaaaatcaatcgctttatagagaccatcagaaagaggtttaatatttttgtgagaccatcgaaggagaaagagataaaacttttttacgactccatcagaaagaggtttaatatttttcttagtacaaaagttaatgttttaaaatatatggatgagaatatttgtctgtataaaaacttgtgtgaaattttgtaccaaagaaaaaacgtgagcagtatcccctatatggattttactagatcatttatatgccaaaaaatattatactatatacgtttattatatgatgttaacgtgtaaattataaacattattttatgatgcaattgtctagtaacctagatgggcatagggatattgataatctctacgagaatatattgttggacgttatcgtttacgaaatagttgaaacatcagaaagaggtttaatatttttatgagaccattgaagagagaaagagaataaaaatatttttgtaaaactttttttatgagaccatcgaagagagaataggaataggaatagtgatcatatcgtatcacatattgagacagaaaaagaagaagtaacgagatgtaactttttgtgaatgtagttaagaacatttttgttttgcaaaccggaatatagtgtccggtacacttttttaattcgtggtgtgcctgaatcgttcgattaaccctacttatccaatttcagatgaatagagttatcaattcagacacacgctttgagttttgttgaatcgatgagtgaagtattatcggttgcacctttagatgccgatccgtcgacatacttaaatccatccttgacctcaagttcagatgattccttgcacatgtctccgatacgaacactaaactctagatttttgacgcattttgtatcgacgatcgttgaaccgatgatatcttcgtaactcactttcttatgagagatgttagacccgagtactggatgggtcttgatgtcgctgtctttctctttttcgctacatctgatgttgatagacacctcacagtctttgatcatagccagagcttcttcacgagtgatcgcgggagagtccttaccttgtcctggggacacactggacaatctagcattcaccgtgtttccgtcagaggattcagagatggataaaatctttgggcattttgtgaatccaaagttcatgttaagacccgcaccaacgatactgtaataagtggtgggatctctttttacaacttcttcggatacctcatcgtctttggtctctgtaacttccgttacggattgacaaatcttatcatcggtcggtgtttggtcttgctttgtgactttgataataacatcaattcccatatgatgtttgttttcttcttccgtacacgaggatgaggatgaaaatgattgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatattgcaactaccgggcatatggctatcgacatcgagaacattacccacatgataagagattgtatcagtttcgtagtcttgagtattggtattactatatagtatatagatgtcgacgctagatagacagtcgcccactagagttacagtctccaaatgcggcatgataccgtcatcattctttgctttcgttaactgtttggaggaaaaatttttgttattgcatttaatctcgaaattcagagtgcacacctttgaaatattttgatatctattttctcctgtaaagaaacctgaagttgctaccttattaaggacagagaagtattcctcacgaaatacgggattacagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggaaaacagatgacgtctccggtagacgtgtgtccggatactccgtatcctattccacattttgtttgggaaacacatgccttgcatccggatgatcctttgagaagacaataatatccgggagagcattcacagattctattgtgagtagtgttacacgatcgcgtctctacctgattactatcgcatcttccgttacaacttagacaagcgggtaaatgattattgcgagatgtgaaggtacccgaaccacacggcgtacattgtgtgttagtcttgctatcgcataatctggaagcgtatgttcccggaggacacgataaacaacacaaattatggcgtttgtattcgttgtctttacactttccattggatggtgcatgcggtgctatatctcttccgtttattattatacatgagagaaacaatatatacaagtataatacggacttcataatttaataatgtagtaatcgttgtcttgttcttgtttcctacttctccaattatatagatattttttaaatattttctttctatcatggataatatttgtaatggttctttccgtacaacatactgtttagatgatagtcgcttagcttggttatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatgtcttctgttcttaataccgtatacaggtcggtgtcggagattcgaatctctttaaggcgacttatgtcacgactgcatttttcgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtaaaacaacgatttaatcataggtagagatactttcagtctgtggtggatgatgtcattcacaacatccgccttgtatatgatgtttctgttttcaaacaccaagtcgaataccgtcttatcgtctttagtcggaaggttgatgtcgtatccgatgtatacgaggtatgaggcaacattgttgttacaattttgaaaggcggtatgaagaggagtcatggtattatagtattcgtctttctgaatgtcgaacctatttagtagataccgtagtatattgagagtgtaacttccgtatccttgattatgttttatgaatagataaagtagatgttgtccttcttccttttgtaatttcccgtatttttgttcgtgccaattgagtaacattatgagaatatgacctgttgcacaatcgttctttatgtattccatgatgggtgtacaatcaagattattacgtatcctcgtatcggctcctcgagataaaagagcatacaccacacgaggactatgtttggtatactgttgaaggtaagtgtgtaacggcgtatttccgatttttgtaaccgcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttagtcaataatttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttaccacattttagtcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatttcatccatctcataatgatttactttttcataattaaagatgtgaaagaaaaagaaaaccgaacaatatattttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctcgagttgtatctccatgggtaatttcgaaatcaagttatcgtctgtattaatgttgtccactatggagtcgatcctctcattgttctttacagtttctgtaatgatggacgttagttcttttttgtaccatttgatgttggatacaaagtttataaatgtcggattctttgcgtatctcaatctgtggcgtttgcttcgtttaaataatatatcaaacatggagacgcctgatatgtaggcattcttcattctattaatgtctactctatagcgctttagttccttatgatgaccggcgatatcatacttactttagaaggaaaatcatcatctatgattaaggcgtatctgatacatgccgataatggttcaggatatagatagcgtatatctctattaaatgcgtcaatcatagtctctagagtgggatggtagctaagtaataaatcaactatcctcgttttgttttctctttggtaactgcttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgagaggatagttgttgtccgttgtcttatccatggtcgctccgttatctaacatgcatcgaacgataggtatacttaccatatcgccgtaatgtaagtagtttatcaacatggcttgtacgatggattcatcctgttgtctaaatctctttagaatgttatcaatgatgtagtggttatattctctggaatcgtacgaagtaatactacgcattacgtcgacaagagtatgacgtctctcaataagaagattaacgatttccatgtctacattatatggggttactctaaatcgcttgtttagataatccgctaatacgcctctaatatagggctgactgacgtcgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagactattgtttgcataattcgtattcttggacggacgtatccgtttatccacaattaggtattttagcagacgtaagtcgatattatccgaagacatatacgaatacagatcgaaatcatttatattcgacttgagtttgttagaggaattcgaatagctggatatcagtagatgcacaatttgagatttgacgtatctatgcttactgtatactcctagcggagttaatccttcgttgtttctacaaagtctctcgactccgcgagagagtaacagccgaacaatcttaatgtctgtatcgcatttattgaagacgtaacaatgtagcgcattgtttcctcgtctatctatatgttttgataagttgtgacacgtttcaatttctagttttattttttcgtacgtcacatcttcatccagtagacgacatagaatacatgtgcaatctctgacgcaatccatagctattctggtgctaattattcctatattatatttcacgaaaaatgatgaaggcaatcattcctcataagatgataaaaagtaaggtgggtgtgataaaaagtgtagtgagtgagtgagtgagaaagtaagagtattagtgagagagcatgaaggagatttagtatttagcagtgcggatatgatccaagagggtgagatagtcgttttcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccgagaactccttcaactcaccaccaaagagctccgttgcatcagttctgaaagagatgagaagcctgtagagagaccctgcgctttctctatgggtccatctatgagaaacccacaggatgtattcagtcagacaatgtctgacgtcggccacggtatacagggagtccttagtagcgtggcaatgacagggtctgaactgggcacaaggaaaggccattgtaaaggtagacgaaggttaacctgatggtagacctgtagccgtctatgctaatagagggctttaatttccatttttttaatgggttgtggatgaggaatgagagtgtcttatttcgtccttggtttacatggatcagagtgagaaaaaaatatcttgtatattattaactaacaaccttggtttccaaatagcttaagaaggcatttacacataatggagatatattccagcagaaaactggataaccgtccaaagtattatttgatatagtagtttttgatataatagacgcgaccccaatagcagtttttgtaaattgaacagggtctatactatgagtaacgtctgatttctgtttaagtttcgtatacaagtcaatgttatagacataatccatatcagagttagagtcataaatatcttttagtacagtaacgcgcatatcatgtataaatggttccccatacgtttcaattgctaagtcctcataagtcgtaaactctttgaatattggtcccatatcatcaatgtttagattatgtacaattctcaaatacgctttgacaagattataaaaccctcttacttgagttttagctacgataactgaaaatggcatatatttgataaactcctaaaagaataattttgtcagggctccatctctcatcaagttacatgtatttgtaataacgtcatttacagtactatttttttgtaaatctaaatttttaatgattctattaacttcttgattattcatggccttaatagcattggatattttatcatccatgtttaaaaaataacctatatgttaatacttgatattgatattaataattagtataattactatgtattatatttcattattatgaggaggatttatgtcatatcatgaaattaataagagaactagattaaagtaatagtaataggaataggaataggaattacttttcgtttgtctcactattataaaaagatgttatatctcaatcactgctataaagatccatcatatactatgatactgtatcagtttctatcaatctctgttttgggtgaattcaaaaaaaattaataatacctagaaaatattccatgagcatttcttttatcgatatagcatttggatagcctgtcaatatcgacatcattgaacaacggattcatcttacacttttcacgaacatcctgagatacattgttccatcttataacccgaattagatcattgtcttcagggaacttagttagccaatcaagaataatatcaatgacctcatcttctttgacatctagatagtcgcagtttatgatattaaacatagaatctgctgatatcaattgtttgaatctaacatccttatacaatgtttcaatctcattagcaatgttttcctcaatcatagtcatgacattgtatttatcctccatttccttatatctattgctaaacaactcatacatctcaagagcgtttctttcatctatcatataatgaaagatacgaactgttgcatggcccaagatctcagaatcaaggaagcgagcaagatcaaacatttcaactacatcttccaactcaagattatccatgactcctgtgtatatgaaatcaatggccatctcgataacaaaacctgaataatcaatattgaagattttttgatctggatcattacttagcatctcagcaaagtatgtagaaaatccagatacagccaccttatgtgcgataatgtcgttgttatcttttgtgtggaatgttatatcacaaaactttccagattttctaagattattcatattgctagctagatcatatctatgtttcacacacaattctttctcatgttcgttaaggtcgtacccacgaacaaaatagtaatcactcattctgacgacagcataaacagtaactaatttttctatctttagagagtatctccctattacctcattatgataatgtgtaaatagatacttcttaataatgtatagatgctgtctataaaaaaatcattcatgggtttgtgtttggacgcttttcatagactgtagtaagtggtcaatattacatcctatgtaatcaatagcagggttagttgcataatatttcatatacaagtcacgcacgatagctatctatctaattaattgttctagtcgcacacatatttggaggtatatagctaatatcgattatgtttcctatatgaatagtagcagtatcctcttcaaatccctcattggtattgacatacgcgatagagatggagatctgatagacagttgcctattaaagtgaaattttcagcgtgtgttgatgctttttcaggaacgcgtgtaaaattaccgattaatacaggttccgtttcagcgttacattttacttttatattcagcgtacacatcttggatgtattttgtttttttgtagtatctgtaaaaagtcctgctatagcagttttaccctttacagagtaatattctgttacaaagactggattgcaatctgttctattaacagtaattgtcaatttagaagtcgtgataacatctgatgattgttttgtacttagtcgattacaagatgatacgttaactggatatagttcaaaatctagagaaatgtagttaaatgtagttaaatgtatctgtaatgtatttgtcttcaaagaaaccgggtgtaggataatcatttgcaaacgatgtaacaaataataatgcgaatattagtattgtgtttatgtttatgtttatcatgatgagtatttatgataacaaagttttgtattatccggagtggtacagcattggtcggttggttctattttctttattgtggtatcaggagtacatctggcacaactattgactgcaggtaccgtacattttaatcctggaccacattgacattttcgtggtttattaggtccacatggttgtatctctaccatattgcttaaacaagtaacacacgccgtacataaaccatcttcaggttcaagatagtaatcattaggacacgttttaccaaatgatgtatatactaggcaggttacgatagcggataaaaagatagtattcatcttcatgctatttaatacatctaatatatgtattagttattaaaaaaatattattttatagaaactttgtgtgtgtatccagaacaattttatcttagtcactctttatctgtaagtcgagcattgataaatgtggcatgttgtctgttaattattatttttttaaaatacgttagtctaaatatcccgataatgcaactaaataaaagagtaacgggaatacgcataacgggatacatatccatgatatattttaatatgtcattggctatataatacatatatcgcgcatctgttatgtacgtattaattatatcatataatggatcattaccatgacaacacgctactagattgtgattttccctatatgcgattatgtcctctttgtaacatttaccaactagtatatcgtatatgctaatattagttctcgaattaatgtgtaactttgtcaacttatcgatgttatttctaatgctaactaacttatcaaatgccaaaaacattgcatgactattatcgagaatcgctatatccctctccatatactcgatgcatttattacagtaatccaatccagctaacataagagccaatctcaatgttggtttaatgatatcatgttcacataataataacgatggaaactttccactagtgtaacacttatctaagaatgatataaccatgtttacattaggtctcttatcgagaatattcttaacaagataccattggtggcccgacaacatattattttccatggttaacattagaggatctacaccattttttgttggtgtattaatattggcttgaatggataataagtaccacaaatgaatccatgacaatattggcattagtatgtgagataatagatacatgtaatggtgtcataccagatgttttacatactgcgttattatatctttctataatagcacaatgatatacgtcatgtatatttgtactatcgtacggctcatattcatcagtatataagttagtaggtatattatatttagcaacaatatgatgaataatgcatggagtgtcggctactctaattaatagatcctgaagtatgcgattttttaccatattcaatactttattagatatcaggcaatctattatgtcataatacatataattttgagcagtgcatatatatgaagttaatggagtataccctaaacaattgacggctgttatatcagcacccaaggatagcagacactgaataacatctcttatatcgttatcggtttttggatctaatatatgaacaacagacaacatagagagatatgtgtgtagtaccatattaccaatattgtcgggttcatttatatcattcccgtactcgtgtaaaagtttaatgatgctagtacttatgttgtgtcgcagaatatattgatgaagacaagtccttccagcactatctttataatgtagttttattcctggttgtaaaaaggagtaaacgactgatatatcgatattccgagctagtgttatatacgagtggagcatcataggtatattttttactttattgccatctagtgattctatatacaagtttgttatttttggattaatattatctatattggctatgtatatcataatcggactcattccattaacgcatttcatatccatatctccccaagttcgataatctttttaattacgtgtacacaaacatttcctgttatcatgtacgtgtgcaacggagtgataagatcacgattctgtaaatttacatttactccgttattgcataaccactctaatatatctatatcaacatccatgttgccgagatacgcgtgtaggataccgtatcctgttttcttgcatacataattaagatttacaattcctacatctaccatatatttagtcaagtctagttttatatggcgagttctcggtgaattgaaatacgtatatagaatatccatatctccattgttgggaatattaaacacatgattggtggttttacttttattatctttaataatacatttgacgaattttttatactgatcaaccaacgatttgttttttctatccgcttttagcattaaagtcatactaccgatgatattaatcaatgcggttttactatctgtatactgttcacgttgtctattatcaatacaataatatttctttttaaaaacttttatgcgtttagctctaactatgtgattataactgtatatatccccatcgctacagtatccatcatctggatcatcattatttatacgagcattagtgcttatacggttatcaaaatcttcaaagtatgtcgaatatatcagttttctgacattaactatagcgtgttcggttaatgatgctattttgataactataatcaaaaactgtcagtgtgttggtagtgcataaaaagtttatattattgttacattttttaaaaagatcaaggtataaaaattagaagtgttagattatattaattatactataaaaattagaagtgttagactattaactaacttataaaactatcttataaaactatcttataactattaactaacttataaaactatcttataactattaactcatttcaagaagggtgggtggagaaaactctatatgatagcttgtgaaacaattagatccctaatttctaatggaagttttgataggagattgtcatcagttgatacattgtttattatctcatctattagagcacgtctgtttagagctttagtgacatgctcgtttacttctgtgtaaatcttgaatcctttagtgatacactgtgtcaaaactggatgtttagaatacctatgtagaatatgggaagcatgcttgtttttgtccttattatagattaactcatacatggttgtattatgaattttcatctgcctaatgtactccaattcttgtttacaatcaattatataatcaaagagtgatgatgcatacacattacaaagtgaataatctaccatcataaaatacttgatacagagctttattacatcatggttttcaattgtattattaagtatagataattttatacagtcaatagacaatggttctctaagcaatatttctaatattttaagatgtgcttccctactggcgataacagatcccctatccacagccacgtcaagacatgtatatccatcactcattactgcgttgacatttgctccattttctaatagccatgatactaaatctatataacctgcatagatagcgcgataaagcaaggtccttccaccagcatctagttgattaatatcttcaatatatgggatacaaagcttacaaatttctaatactgtgggttcatctacaaggaatcccctagtatactgaattattttatataaatctaacttaacatcattttcatctgggataccacaatttaaaataaactcaacaacactactttcctttttacacattcccctaaaataggcattcaagcattctattttatatattacagccccatgatctaccataaaattaacaatgtctatttttacatatgcattagatagatagtaaagtaagagatcttgcacagaattacaattcttaataattataaagataatatcttccatataattctttgacactaatgcagatataatatctttatatgtaatatatgtaaacagtctatctactatatactgatcaatattatctctatgaatcctaaaataatcatacagaacatctacaggatcacaaattggttcaaggagaaatctatcaaatattttcctgtcaacaactggttctagaacataacagtcaacacccaatccatgttttacatagtcatctaccaaagataatgaccaaatgttgaggtcgtcgtgaaactgctcatcaacagccatgaaatctgccgactccatggtgcgaatcgcactgtcttattcgccattgattttcattttttataattatgtacatgatttccttctattctcaagagtctacaaaatatatattttttcgatatctaagtactaagttttttactgtttttgttactgtcccattcttctaactaaagatctgagataaattatacaatcttcgctatcaaaccatttttgtagtttaaagcctgaagtaattagccaactgtttttattagcggcttttttcgatctatcaatttcagtatattcttcgctgttataaaagtaatgttgtttaattgtaggacggttgttagtataatcacatgaataataatattctaattcctcgtattaactacttacagatactcgaaatagtctgaaaaattcttcaaagatatttttataaagatctaggaaaagtttattaccaaccatgaacgcgataaatggataaatatcctttccatcaaaggtcataattggataattgtccagcaatatatctgctgtattagttatatcacttccatttattttcagattgaagtaatgtactagtttgtgacaattaacaagagacaaaagagatgccgatactaatacgtaaatagctatacgcgaatccattgttacttttttatttcatacgtctattaataaatatatgtattacttaagactagaaaaatcaaaagtgagtttttgatatttgattcttacttattgtgggattgtagtttactaagtaattcatctctgaatcctgataaatcatgcatatcattgatacaactacgcagtaaactagtaggaatacaaatatctggatatgtacgtaaatagtcgattatatcttttacaatactattagtccctattgcgttatctatatatccattaataatattacacagtggatacttatcagaagtatacctcttacagatttctatacataaagtaatatcattattgtatgttttgcttattagtatcatatataaatatagtagaatagttgttaatatatgtagacattaataaactaatattatctcgaatatccactatcacgtctaaagtttgactcagtgatctataattagatgtattttgtgtttccaaatcatgttttatatgctcgataaatttgttacaattatttactcctatcaacataaatgcagaggccatcatttcatacaggctagtatttttagtactacataacgaaaataatgattcgtttttatagcatttatctaaaaatattataatattatctatagaaggtctgttatctagtaacatcttaactatatgacacttattatatcgatctctatgaaatattaacatcaatgcagaaataccctttatagttggtttatcgatactatatccaatagataataaatatttcattgcatctttgagtagacaaacggtggctacgtgaaacgcagtcattccagaaaatggtactatattcttatagtactttatcatttgacaatgatatgcatcattagtttcgtaatcacacttttcatattcatcggtgtatgagtctacaggaatattatatttagtaataacatgatgaattattggcagcgatatatcttctctagttattagatcttggattatacaatgctttaccatgtttaatactttatcagacatcagacaatctattatgtcgtgatacatataattttgtgcggtacatatgtaggacgttaatggggtataacctaaattattaaccaacgatatatctgatcctgaacgtataagatatttaacaacttttatgtttatattgttattgatactcgaatcatatgtcaaattttattaacgatacataaatctagaaagatatgtgtgtagtactgtattacctaaattatcagtctcgtttaaatagttgccgtgttcgagtaaaagtttaacgacatcgatatttatataatttcgtaacatatagctgtgaagacaagtttttccaacactatctttgtaatcaaggattgcactattattcagaaaatgttttatgacatctagatcaacatattgagccatttgtatatacagatacaatatctctggtatattagttatcttgttatcgtccatgtaaatctttataatttcttcgtctatattcatcgcattatatattatataagttattataggagttaactttatacaacatctgagattcctatcagcacctagttcaataactttctttaacacgcttgctgaaattaattcgtctctccgtaaatatgaatgtaatggagtaattagattattgttttgttcatttatattctttccacttttacataataattttagtacatctgtgtctacatacatattaccgagatatgtatgcaatataccaaatccatattcgtttttataattaatatctacgcctttagcaatcatccatttaaccaattttatgttgatgcctatcgtgttatgtgctttgaaatatacagagaatatgttactactatatttgtcactgttttcataatgactatctcgtcctcatcatcactatcatcactatcatcatccttcgttcttattatcatctttatcatcatccttattgtccttatcatcgtctattaaacacaaattatctacgtttataacaacattctcatcattaattagttctgtagtaatatctttaataatttggctatatatctgttcaatactatctattgatgatttctttttatgacttgaactaatgtaatgacgatgaaattgagtagtagcttttaataaagacttgatatcattatcatatgtttgatcgtcgtaattaatagtgtggctaatggtactgttaataagtttatagacaatatcatagtattttctttccagaactagattattttttaatactgatctaacatatatgtcgtaactatcatactggttctcacaattccgtgatgtagcagtagttgatgcatggtctatatcgttaaaatgtatcgtatataatagttttctgacgtggagtacagaattttcgattaatgagttcatggtaaggaagggcgaatgaatgcctgtatatatgcataagttaatagttttttatcatatttttctaatactatataaaaatatcattatgtataatcatcactgtcgctatcattattgtgtttgtgtagttctgtcctatcatctacatcactgctactgtcactctcgctatatcttctaaaattacaaacaactggatattcgataacagcatttgagtagtttttgtcttttacagtatatacgttattgtcaaaatctaaacaaatattagcataatacctatctataagatcaagatccatgttcgagcatactagtgcatatttgtaacttcgtcgtacagcgttagatcaataaataaacaatcttataacgcaactttttacgatctagttgtatgagtttatcgtttacataagctattaacggctttaacagatgatctgagtaatatacctctgttatacatttaatgttcacggtcttagtatttttagatatcaattgtaatttacacccatatttaactcccttgtgtaacgttagacattctaaatctatagtattatctattacagcgtaaaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccattaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaaatatgcgatgtatctatgttatttgtatttatctaaacaatacctctagctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcattttctgtgacggaagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagttattgatctattatatgaaacggatatgtctagaacagcaattgtcttacgtccagttaacactttctttgatttaaagtctagagtctttgcaaacataatatccttatccgactttatatttcctgtagggtggtataattttattttgcctccatatatcggtgtttccaaatatattactagacaatattccatatagttattagttaagggtacccaattagaacacgtacgcttattatcatcatttggatcgtatttcataaaagttattgtgttatcgatgttaacacattctacattttttaattgtctatatagtatttttttgatattttctataatatcagaattgtcttccatcgaaagttgtatactatcagaatcagttacatgtttaaataattctctgctgtcattccttatacaatcaaattcattattaaacagtttaatagtctgtaaacctttatcgtcgtaaatatccattgtcttattagttacgcttatttttatgtgtttttacgttgctttattatattttataagaatgattgtttgacgaatcacgagaactattaagacatatattattagaggtatatattataaaaaagtttttgattacgttgttataagaggagaggacacattaacatcatacatcaattaactacattcttataacatcgtaatcaaaagaattgcaattttaatgtataacaactgtcaatgggttatggaattgtatattacatattatacggtatgttggtaacgacaaataccgatcggtaatcgtttgccggtgtaataaaattatatatatctatctattacaccggctgagtatgcataataataagttgtgggtagtatcatccacatatttataatttaggactttgtattcagtatttttggaatcataaaaaaataaaaaagttttaccattttaaaatttaaaaagtatttacattttttcactgtttagttgcggatatggaatttgatcctaccaaaatcaatatatcatctatagatcatgtaacaatattacaatacatagatgaaccaaatgatataagactaacagtatgcattatccaaaatattaataacattaaatattatatcaatatcacaaaaataaatccacatttggctaatcaatttcgggcttggaaaaaacgtatcgccggaagggactatataactaacttatctaaagatacaggaatacaacaatcaaaacttactgaaactatacgtaactgtcaaaaaatagaaacatatatggtctatatatacactacaatttagttattaatgtggttattgattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtgaaatttgctatgaagttgtttactcaaaacgattagaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacaatgtacagtcatctataatcatggcatatttaatacattgttttatagcatagtagttatctacgatgttagatatttctctcaataaatcaatcacataatctaatgtaggtttatgacataatagcattttcagcagttcaatgtttttagattcgttgatggcaatggctatacatgtatatccgttatttgatctaatgttaacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccaacatgcattccactagagggatatcgatatcgccgaatgtcatatactcaattagtatatgttggaggacatccgagttcattgttttcaatatcaaaaagatggtttccttatcatttctccatagtggtacaatactacacattatttcgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcatcctcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttaaattggttcctggtatcattaggatctctgtctttcaacatctgtttaagttcatcaagagccacctcctcattttccaaatagttaaacattttgactgaatagaagtgaatgagctactgtgaactctatacacccacacaactaatgttattaaatatcattttttgaatgtatttataccatgtcaaaaacttgtacaattattaataaaaataatttagtgtttaaattttaccagttccagattttacacctccgttaatacctccattaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatataattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcaactaatatgaagtacttgatacatattttcagtaacgatttattattaccacctatgaataagtacctgtgatcgtctaggtaatcaactgtttttttaatacattcgatggttggtaatttactcagaataatttccaatatcttaatatataattctgctatttctggaatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaaactgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcataaccactatagttactatcgaataacgcgtcaaatatttcccgtttaatatcgcatttgtcaagataataatagagtgtggtatgttcacgataagtataataacgcatctcttttttgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttttattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtttatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtttagatctatagaatcaaaacacgataggtcagaagataatgaatatctgtacgcttctttttgtactgtaacttctggttttgttagatggttgcatcgtgctttaacgtcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcgtcgtggcaatttcctaagacgaaaataagacataaacacgcaataaatctaattgcggacatggttactccttaaaaaaatactaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaaaagttcgttctcatcatcagaataaatcaatatctctgtttttttgttatacagatgtattacagcctcatatattacgtaataaaacgtgtcatctaccttattaacttccaccgcatagttgtttgcaaatacggttaatcctttgacctcgtcaatttccgaccaatctgggcgtataataaatctgaactttaattgcttgtacccatttgaaataatttttaatcgacatccgtagttatcccctttatgtaactgtaaatttctcaacgcgatatctccattaataatgatgtcgaattcgtgttgtatacccatactgaattgatgaactaacgaatatcaacggcgttaatagtaatttactttttcatctttacatactgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaaaattatctatctacatcatcgtctattggataacgtctctgtattctacgatagagtgctactttaagatgcgacagatctgtgtcatcaaatatatactccattaaaatgattattacggcagcgaacttgatattggatacatcacgacctttgttaatatccacgacaatagacagcaatcccatggttccataaacagtgagtttatctttctttgaagcgatagtttgtagagatcttataaaaccgtcaaacgacatcgcatttatatctttagctaattcatatatgttaccatcgtaatatctacccgcgtctatcttaaacgtttccatcgctttaaagacgtttccaatagatggtctcatttcatcagtcatactgagccaacaaatgtaatcgtgtataatatctttgatagaatcagactctaaaaaaaaggaatcggctttattatacacattcatgataaacttaatgaaaaatgtttttcgttgtttaagttggatgaatagtatgtcttaataattgttattatttcattaattaatatttagtaacgagtacactctataaaaatgaaaatgacataactaatcataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacaactgaatctacatccaattttagaaattggtctgtgttacatatttcttctatattattgttgatgtattgtcgtagaaaactattacgtagaccattttctttataaaacgaatatatagtactccaattatctttaccgatatatttgcacacataatccattctctcaattactacatctttaagattttcgttgttaagatatttggctaaactatataattctattagatcatcaacagaatcagtatatatttttctagatacaaagacgaactctttggcgtcctctataatattcccagaaaagatattttcgtgttttagtttatcgagatctaatctgttcatatacgtatctatgattgtacggtacgttatgataaccgcataaaataaaaatccatttttatttttagctactattcataattgagattgatgtaatactttgttactttgaacgtaaagacagtacacggatccgtatctccaacaagcacgtagtaatcaaatttggtgttgttaaacttcgcaatatttatcaatttagatagaaacttatactcatcatctgttttaggaatccatgtattattaccactttccaacttatcattatcccaggctatgtttcgtccatcatcattgcgtagagtaaataattcttctgtattcggtagttcaaatatataatccatgcatagatcggtaaagctattgtagatgtgatttttcctaaatctaatataaaactcgtttactagcaaacattttcctgatttatcgaccaagacacatatggtttctaaatctatcaagtggtggggatccatagttatgacgcagtaacatagattattaccttcttaactgtcgctaatatctatatatttattgttatcgtattggattctgcatatagaacacataaccaatttatagtcgcgctttacattctcaaatctacagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttatataatatctctctgatataatcagatatatttattgtgtcggtagatgataccgttacatttgaattaatggtgttccattttacaacttttaacaagttgaccaattcatttttaatagtatcaaacgctccatgattaaatattttaatagtatccattttatatcactacggacacaaagtagctgacataaaccattgtataatttttatgttttatgcttattagcgtacacattttggaagttccggctgccatgtatttcctggagagcaagtagatgatgaggaaccagataggttatatccgtacttgcacttaaagtttacattgtcgttgtatgagtatgatcttttaaacccgctagacaagtatccgtttgatattgtaggatgtggacatttaacaatttgacacgtgggtggatcggaccattctcctcctgaacacaggacaccagagttaccaatcaacgaatatccactattgcaactataagttacaacgcttccatcggtataaaaatcctcgtatccgttatgtcttccgttggatatagatggagggaattggcatttaacagattcacaaataggtgcctcgggattccataccatagatccagtaaatcctaattcacaatacgatttagattctcctatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcattagttttcacactattcttaaatttcatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagttacgttacactttggagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgatgcgcctgaatatctaggagtaattaagtttggaagtcttatccattttgaagtgccgtgtttcaaatattctgctacacccgttgaaatagaaaattctaatcctcctattacatataactttccattgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagttataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcactgcagtaatattgttgattatttctgacatcgacgcattatatagttttttaattccatattgtttagaaaagttaaacatccttatacaatttgtggaattaatattatgaatcatagtttttacacatatatctactacaggcgtaacatcaattattacggcagcaactagtatcatttctacattgtttatggtgatgtttatcttcttccagcgtatatagtctaatagcgattcaaacgcgtgatagtttataccattcaatataatcacttcatcatttatatggtgctcctgaattcgtttaaaaaaattatacggagatgccgtaataatttccttattcacttgtataatttccccattgatagaaaacgtcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctattgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgattagacaaataaagaaaatcagatgatcgatgaataatacatttaaattcatcatctgtaagatttttgagatgtctcattaaaatattattagggtcagtactcattatcattaggcagctattacttattttatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagtaatttaactattttagttaacaactattttttatgttaaatcaattagtacaccgatatgtttaatacttattcatattttagtttttaggattgagaatcaatacaaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatatcctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagttaggatgcataagtacaaagtacgcgataaacggaataataatatatttatctagtttatctttttttatcgcgttcatagttagatacatagtctcagaagtaggattatgtaacatcagcttcgataaaatgacggttatttagttttacacattcgctcatacatgtatgaccgttaactacagagtctacactaaaatgattgaacaatagatagtctaccattgtttcgtattcagatagtacagcgtagtacatagcatcttcacaaattatatcaatgtctaatagatatttgacgcattttatggatcccacttcaacagccatcttaaaatcggtaaaatcatattgctttcctttatcattaataatttctaaaacatcatctctatcataaaagatacaaatattaactgtttgatcagtaataacattgctagtcgatagcaatttgttaataagatgcgctgggctcaatgtcttaataagaagtgtaagaggactatctccgaatttgttttgtttattaacatctgttgatggaagtaaaagatctataatgtctacatacttgactgttttaaagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcaaatccgatggacattatttttttaaacactctttctgaaggatctgtacacgccaacaacagaccacatccttcttcatcaacctagttgttaatcttggctccatactgtaccaataaatttattctctctatgacttcatcatctgttcccgagagataatatagaggcgttttatgctgtttatcacacgcgtttggatctgcgccgtgcgtcagcagcatcgcgactattctattattaattttagaagctatatgcaatggataatttccatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggaataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgctatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcagacttgtattcaacatgcttttctataatcatcttagttattttagcatcatccaatagtacattttccagattaacagagtagatattaatgtcgtatttgaacagagcctgtagcatctcaatgtctttattatctatagccaatttaatgtcgggaatgaagagaagggaattgttagtgttggtaaatgccatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagtttcaccgtttgcatgttaccactatcaaccgcataatacaatgcggtgtttcctttgtcatcaaattgtgaatcatccattccactgaatagcaaaatctttactattttggtatcttctaatgtggctgcctgatgtaatggaaattcattctctagaagatttttcaatgctccagcgttcaacaacgtacatactagacgcacgttattatcagctattgcataatacaaggcactatgaccgttgatatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatataaacaatattaaggagattccaccttacccataaacaatataaatccagtaatatcatgtctgatgatgaacacaaatggtgtattaaattccagttcttcaggagatgatctcgccgtagctaccatgatagtagatgcctctgctacagttccttgttcgtcaacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattaaacataccggatctacgttctactatagaattaattttattaaccgcatctcgtctaaagtttaatctatataggccgaatctatgatattgttgataatacaacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttcattcccatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatatttaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgattttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacggtaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatcttgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggggggggtgttaatcttggaaattatttttctaaccttgttggtagcctttaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaactgttgctcccatggaatgacccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaattaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttctactggattcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtagacttgtcaaatctatataccatattttctggaagtggatatacatagtcgtgatcaacattattgctagcctcatcttctatatcatgtactataccattatctatatcctctatatcctgtactataccattatctatatcctctatatcctctatatcctgtactataccattatctatatcctctatatcatctacataatctacgatattattacacataaacatcgacaacatactattgtttattatctaagtcctgttgatccaaacccttgatctcctctatctgtactatctagagattgtacttctttcagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatcttcttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacaaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtaaaaccattaagcgcgaaagatgttattttgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtaccgcaaactcgatatatttaaacaagttaatgagatattaacgcgttttatgaatgatgatatataaccagaagttttatcctcggtggctagcgctataaccttatcattataataccaactagtgtaattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttatttttattcttattcttattcttagcgtcacagaatctaccacagcaggatcccatgacgagcgtcatattaaactaattcattttcaattataatatatgattagtaatgaccattaaaataaaaaatattcttcataaccggcaagaaagtgaaaagttcacattgaaactatgtcagtagtatacatcatgaaatgagatgaaatgatgatatatatatatatatactctattttggtggaggattatatgatataattcgtggataatcattcttaagacacatttctttattcgtaaatcttttcacgttaaatgagtgtccatattttgcaatttcttcatatgatggcggtgtacgtggacgaagctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattttccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatgaaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacaaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatgttgttaaaatataaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaacacctccacagtttttaatttctttagtaatgaaattattcacaatatcagtatcttctttatctaccagagattttactaacttgataaccttggctgtctcattcaatagggtagtgatatttgtatgtgtgatattgatatctttttgaattgtttcttttagaagtgattctttgatggtgtcagcatacgaattacaataatgcagaaactcagttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgatgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtaactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgttgccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtatttcattgtaaatttataggcggtgtatttaagttggtagattttcaattatgtattaatatagcaacagtagtttttgctcctccttgattctagcatcctcttcattattttcttctacgtacataagcatgtccaatacgttagacaacacaccaacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagttacaatcaccactttcatatttagaatatatatatgtaaaaatatagtagaatttcattttgtttttttctatgctataaatgaattctcattttgcatctgctcatactccgttttatattaataccaaagaaggaaaatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattattgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcttaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaaacataatactctgttggttttcttatatacaatattacgattttcttctttgaatggaataggtttttgaattagtttataattacaacataatagataaggaagtgtgcaaatagtacgcggaaaaaacataatagctcccctgtttttatccatggttttaagtaaatgatcactggcttctttagttaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttttatcttctaaaaaatcttcaacgtatggaatataataatctattttacctcttctgatatcattaatgatataatttttgacactatcttctgtcaattgattcttattcactatatctaagaaacggatagcgtccctaggacgaactacttccattaatatctctattatagcttctggacataattcatctattataccagaattaatgggaactattccgtatctatctaacatagttttaagaaagtcagaatctaagacttgatgttcatatattggttcatacatgaaatgatttctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgttgatatagattttagacattttagagagaactaacgcaatcagtaataaaactaatttattttatcattttttttattcatcatcctctggtggttcgtcgtttctatcgaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggtgtagtattcctacttttacagttaggacacggtgtattgtatttctcgtcaagaacgttaaaataatcgttgtaacttacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttttggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataattatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccaaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgttgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagataattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcatagccaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagcagtagagtatctaatggataaactgaaactaacaaagagcgatgtacaactgttgtgaatattttatgcttcgtaaaatgtaggttttgaaccaaacattctttcaaagaatgagatacataaaactttattatccaataaattgactatttcggatgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtcctttagacaacatttcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagttgttctaactctttcgctatttctatagacttatcgacatcttgactgtctatctctgtaaacacggagtcggtatctccatacacgctacgaaaacgaaatctgtaatctataggcaacgatgtttttacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactattttgtacgtatattgcatggaatcataaatggccttttcagttgaactggtagcctgttttagcatctttttatatctagctctctctgccaaaaatgttcttaatagtctaggaatggttccttctattgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgttaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatatacagcttcctttttgtctggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttctgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactattgctatagaggacaataatgtcatgtctagcaatgatctgaattatatttattattttttcatcagattatttaacaatttggcatctgatcccaaatacgcaatcaatgtgtcaaaggttaaacctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaataacgttgatggacaaataatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctttatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatgtcggagttaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagttgagatatatggacgcagatagctatatgatagccaactacagaaggcaaacgctataaaaaacataattacgacgagcatatttataaatatttttattcagcattacttgatatagtaatattaggcacagtcaaacattcaactactttcgatacattaactttctcattttctttaacaaattctgcaatatcttcgtaaaaagattcttgaaactttttagaatatctatcgactctagatgaaatagcgttcgtcaacatactatgttttgtatacataaaggcgcctattttaacagtttctagtgacaaaatgctagcgatcctaggatcctttaaaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatacgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcgtccagtttgccattctttgtaaagaaattattttctactagactattaataagactgataaggattcctccataattgcacaatccaaactttttcacaaaactagactttacgagatctacaggaatgcgtacttcaggttttttagcttgtgattttttcttttgcggacattttctagtgaccaactcatctaccatttcattgattttagcagtgaaataagctttcaatgcacgggcactgatactattgaaaacgagttgatcttcaaattccgccatttaagtttaccaaacaacttttaaatacaaatatatcaatagtagtagaataagaactataaaaaaaataataattaaccaataccaaccccaacaacctgtattattagttgatgtggtagttttctcatcacttagaacagatttaacaatttctataaagtctgtcagatctgtcaaatcatctttcggagaacccatatatacaccaaatatagcggcgtacaacttatccatttatacattaaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttctgttccggatctatagaagacgataggtgtgataattgccttggccaattgtctttctcttttactgagtgattctagttcaccttctatagatctgagaatggatgattctccagccgaaacatattctaccatggctccgtttaatttgttgatgaagatggattcatccttaaatgttttctctgtaatagtttccaccgaaagactatgcaaagaatttggaatgtgttccttgtgcttaatgtttccatagacagcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagatgaacaattagcgtattgagaagcatttagtgtgacgtattcgatacattttgcattagatttactaatcgattttgcatactctataacacccgcacaagtctgtagagaatcgctagatgctgtaggtcttggtgaagtttcaactctcttcttaattaccttactcatgattaaacctaaataattgtactttgtaatataatgatatatattttcactttatctcatttgaaaataaaaatgtttttgtttaaccgctgcatgatgtacagatttcggaatcacaaaccactggtggttttattttatccttgtccaatgtgaattgaatgggagcggatgcgggtttcgtacgtagatagtacatttccgtttttagaccgagactccatccgtaaaaatgcatactcgttagtttgaaataactcggatctgctatatggatattcatagattgactttgatcgatgaaggctcccctgtctgcagccatttttatgatcgtcttttgtgaaatttcccaaatagttttataaactcgcttaatatcttctggaaggtttgtattctaagtggatccaccatctgccataatcctattcttgatctcatcatttcataattttttctcggttaaaactctaaggagatgcggattaactacttgaaattctccagacaatactctccgagtgtaaatattactggtatatggtttcaccgactcattattttccaaaatttgagcagttgatgccgtcggcataggtgccaccaataaactatttctaagaccgtatgttttgattttatcttttagaggtttccaattccaaagatctgacggtacaacattccaaagatcatattgtagaataccgttactggcgtacgatcttacatatgattcataaggtccttccttttcagctagttcacaactcgcatctaatgcaccgtaggtttcgaagatcttcttatttagatcttgtgcttccaggctatcaaatggataatttaagagaataaacgcgtccgctaatccttgaacaccaataccgataggtctatgtctcttattagagatttcagcttttggaataggataataattaatatctataattttattgagatttctgacaattactttgaccacatcctttagtttgaaaaaatcaaattgtccatctattacaaacatgtttaacgcgacagatgccagattacaaacggctacctcattagcatctgcatattgtattatttcagtgcagaggttactacacttaatggttcctaaattttgttgattactctttttgttacacgcatccttataaagaatgaacggagtaccagtttcaatctgagattctataatcgctttccagacgactcgagccttcatatagtcttgtatctcttttctctttcgtattgtatataatcgttcgaactcgtctccccaaacattgtttaatccagaacattcatccaaacacatcaacgaccactctccgtcatccttcactcgtttcataaagagatcaggaatccaaagagctataaataaatctctggttctatgtttctcgtttcctgtattctttttaaaatcgaggaacgccataatatcagaatgccacggttccaagtatatggccataactcccggtcgtttgtttcctccctgatccatgtatctagcggtgttattataaactctcaacattggaataataccgtttgatataccattagtaccggagatatagcttccactggcacgaatattactaattgataaacctattccccctgccattttagagattaatgcgcatcgttttaacgtatcatagatgccctctatactatcatccatcatgttaagtaaaaaaacatctagacatttggtgacgactagttctcgcattaaataaggtaggagaagcgtgcgtaaaccatttttcagaaagtagattgtacgtctcaatagctaagtctatattccattgatgtatttttaccgcgacacgcattaacatgtgctgaggtttttcaacgatcttgttgtttatttttaacaagtaggatttttccaaagttttaaaaccaaaatagttgtatgaaaagtttcgttcgtaaataataaccgaattgagtttatccttatatttgttaactatatccatggtgatacttgaaataatcggagaatgtttcccatttttaggattaacatagttgaataaatccttcatcacttcactaaatagttttttgtttccttgtgtagatttgatacggctattctggcggctagaatggcataatccggatgttgtgtagtacaagtggctgctatttcggctaccagagtgttcaattctaccgttgttactccattatatattccttgaataaccttcatagctattttaataggatctatatgatccgtgtttaagccataacataattttctaatacgagacgtaattttatcaaacatgacattttccttgtatccatttcgtttaatgacaaacatttttgttggtgtaataaaaaaaattatttaacttttcattaatagggatttgacgtacgtagcgtacaaaatgattgttcctggtatatagataaagagtcctatatatttgaaaatcgttacggctcgattaaactttaatgattgcattgtgaatatatcattaggatttaactccttgactatcagggcggcaccagaaatcaccatcaaaagcattaatacagttatgcctatcgcagttagaacggttatagcatccaccatttatatctaaaaattagatcaaagaatatgtgacaaagtcctagttgtatattgagaattgacgaaacaatgtttcttacatattttttttttattagtaaccgacttaatagtaggaactggaaaactagacttgattattctataagtatagatacccttccagataatgttctctttgataaaagttccagaaaatgtagaattttttaaaaagttatcttttgctattaccaagattgtgtttagacgcttattattaatatgagtaatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaatttcttgacgctattggagttgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcgtcgtcgacgcccgtcaaccaaccgaacggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcaatgtcgcaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaaaacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgtttgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaaccggagtgggtaagacgtcacaggtacccaagttattgctttggtttaattatttatttggtggattctttactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacattagaggatgaccgagaacggctaaaagtatttttacctaatcccgcatttatacatattcctggaaatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgttcccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgcacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttaaagatgaaaaattttctacatctccttttgtagacacaactaaacattttgcagaaaaaagtttattattgtttagataatcgtatacttcatcagtgtagatagtaaatgtgaacaaataaaaggtattcttactcaatagattggtaaattccatagaatatattagtcctttcttcttgagatcccacatcatttcaaccagagacgttttatccaatgatttacctcgtactataccacatacaaaactagattttgcagtgacgttgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacaatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaaaaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattttcgaatccgaaattagaaattcccaagtagatatcctttttcatccgatcattgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagataaggaatcgttggagttagtgtcttccttatgtaggggatttgaaatatcttataatgacttaataacttactttccagataggaaataccataaatatatttctaaagtatttgaacatgtagatttatcggaggaattaagtatggaattccatgatacaactttgcgagatttagtttatcttagattgtacaagtattccaagtgtatacggccgtgttataaattaggagataatctaaaaggcatagttgttataaaggacagaaatatatatattagagaagcaaatgatgacttgatagaatatctcctcaaggaatacactcctcagatttatacatattctaatgagcgagttcccatagctggttcaaaattaattctttgtggattttctcaagttacatttatggcgtatacaacgtctcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatctgttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctaatacgtcgttaactttactaggtattccatatggatttggtcatgatagaatgtattgttttaaattggtagctgactgttataaaaatgccggtgttgaaacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggtggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctaatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactaatgagatgttattaaacgttgataaaatgcatgacgtgatagctcccgctaagcttttagaatatgtgcatataggaccactagcaaaagataaagaggataaagtaaagaaaagatatccagagtttagattagttaacacaggacccggtggtctttcagcattattaagacaatcgtataatggaaccgcacccaattgctgtcgcacttttaatcgtactcattattggaaaaaggatggaaagatatcagataagtatgaagagggtgcaatattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcagcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacaagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgactactaaggccactactcaaatagcacctaaacaagttgctggtacaggagttcagttttatatgattgttatcggtgttataatattggcagcgttgtttatgtactatgccaagcgtatgctgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgaggggttaatttcacaactttactgtttttgaactgttcaaaatatagcatcgatccatgagaaatacgtttagccgcctttaatagaggaaatcctaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaaccttatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttagagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgttattcctaaaaaaagtggtaggagaaagaataaaaacatggttatcttccgtcaaggatcatcacctatcttgtgcattttcgaaactcgtaaaaagattaatatttataaagaaaatatggaatccgcatcaactgagtatacacctatcggagacaacaaggctttgatatctaaatatgcgggaattaatatcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtattaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataagttaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagttgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaagaaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatcggctcctggtacacatatacgttatttgagagatcatttctataatttaggaatgattatcaaatggatgctaattgacggacgccatcatgatcctattctaaatggattgcgtgatgtgactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtatactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttatatcttatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcatcttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtataccttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagacggctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgattttgacggggatgaggaatggatgatattagaacaaaatcctaaagctgtaattgaacaaagtattcttatgtatccgacaacgttactcaaacacgatattcatggagcccctgtttatggatctattcaagatgaaatcgtagcagcgtattcattgtttaggatacaagatctttgtttagatgaagtattaaacatcttggggaaatatggaagaaagttcgatcctaaaggtaaatgtaaattcagcggtaaagatatctatacttacttgataggtgaaaagattaattatccgggtctcttaaaggatggtgagattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaaagatgtaagagacgggaaaatagttccattatctaaagctttagaagcggactacgtggaatccatgttatccaacttgacaaattttaatatcagagagatagaagaacatatgagacaaacgctgatagatgatccagataataacctcctgaaaatggccaaagcgggttataaagtaaatcctacagaactaatgtatattctaggtacgtatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgaaagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagtcgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggagaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagttaataaattcaagttcggtgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcagtaaacgcatgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaatttggtttcatgttttcaaagcggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatctcttttttctggcataacttcgttgtccttcacatcatcgaacttctgatcattaatatgctcatgaacattaggaaatgtttctgatggaggtctatcaataactggcacaacaataacaggagttttcgccgccgccatttagttattgaaattaatcatatacaactctctaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaagaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggataaagaaaaggaggaagtggaagaagaagtagttatagaggaatatcatcaaacaactgaaaaaaattctccacctccgttatcatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctataactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacaaaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattggatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaaaaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattttgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctatatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaacccgttattgtcaccgtattatcgtaatttagtagccagacaaatggtcaataatatgatttttaatcaagattcatttttaaaatatttattagaacatctgattagaagccactatagagtttctaaacatataacaatagttagatacaaggataccaaagaattaaatctaacgagaatatgttataatagagataagtttaaggcgtttgtattcgcttggtttaacggcgtttcggaaaatgaaaaggtactagatacgtataaaaaggtatctaatttgatataatgaatttggtgactgtatcacacgcaccatatactattacttatcataatgattgggaaccagttatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataaaatttctaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgtccttaagactataggtgtcccatcagcatgtagacaaaatgaagatccaagattcgtagaagcatttaaatgcgacgagttagaaagatatattgataataatccagaatgttcactatttgaaagtcttagggatgaggaagcatattctatagtcagaattttcatggatgtagatttagacgcgtatctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccacctcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagatttgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaattatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcaaacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaatccgttaatgtatatcttttagccgccgtatattccgatttcaatgacgaagtgatgtcattaaacgattacacacaggatgaattgattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatatgatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattgactatcttttgaaaatatacatttttatgatccaatacttgtaaaaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataggttattgcatggcgtgttttattaatcaatcgttgaaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgaacaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattgacgataggtgtagctgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagactgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaaaactgctttaggtgctgaaataaccacatctggaaggcttactcgcttagccatttaattacggaactatttttttatacttctaatgagcaagtagaaaacctctcatctacaaaaacgtactcgtgtccataatcctctaccatagtaacacgttttttagatctcatatgtgctaaaaagttttcccatactaattggttactattatttttcgtataatttttaacagtttgaggttttagatttttagttacagaagtgatatcgaatattttatccaaaaagaatgagtaattaattgtcttagaaggagtgttttcttggcaaaagaataccaagtgcttaaatatttctactacttcattaattttttcggtactcagattcagtttctcatcttttacttgattgattatttcaaaaactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctctgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacagacagcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtaatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctatcgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttactcttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttaagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttggtagtttgttgagcttgatcatttcctgcacgtttaggtttggtacgttgatttctagcccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggtgcatcagtatcttcagacagccaatcaaaaagattagacatatcagatgatgtattagtttgttgtcgtggttttggtgtaggaacagtactactaggtagaagaataggagccggtgtagctgttggaaccggctgtggagttatatgaatagttggttgtagcggttggataggctgtctgctggcgaccgtcatattatctctagctagttgttctcgcaactgtctttgataatacgactcttgagactttagtactatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgttggtaaacgattttgacaaagatggtctaaaattccatctagactatattatcaaaatttggaaacttcaaaaacgatattagaatttatacgaatatcgttctctaaatgtcacaatcaagtctctcatattcagcaggttattgtcgtactttatatcgtgttcattaacgatattttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctattgtgtctgttaatagacatccaacatcgacattcgacgtcaattgtctataaatcagagtataaattttagaaataacattagcaaattgttgtgcgttgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacataatctagtttattatataccgatttcacaacggcaccagatttaaggaaccagaatgaaaaactctgataactacaatatttcatcatagttacgattttattatcttctatagttggtgtaatagcgcatacctttttttccaagactggaaccaacgtcataaaaatgtttaaatcaaaatccatatcaacatctgatgcgctaagaccagtctcgcgttcaagattatttttactaatggtgacgaactcatcgtatagaactctaagtttgtccattatttatttacagatttagttgtttaatttatttgtgctcttccagagttgggatagtatttttctaacgtcagtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcagttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcatgtaaacattatgccgttatcattaataaagacttctttctcatcggatttgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaataatagatatttttttatccgaggatagtaaaatattattagtcgccgtctctataaaaataaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctatttgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcattaacgagttaaaaaagaccagttcattcaagataagcaaacgcgataaggatacgctattaaaatattttacttaggactagagttagaatttatagacgactcatttcgtttatcattattactattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgctattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttaactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcttttgtttagaacgattagctacagagttcaacgcttggctgactagcatattattatctttagaaattgtattcttcaatgaagcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatctacgtttggtaatggtaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacttgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacttttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagctatcgttaattatgcaaatttgaacgggtcccccttatcagttgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctaaaagatcgtgattgatctctccgaccattccacgaacttctaattggccgtctctaacggtaccataaactattttaccagcattagtaacagcttggacaatctgaccatccattgcgttgaatgatgtagttgctgttgttctacgtctaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccactaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcaccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacaaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtacacccaacgtatttacatctagttctttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctattgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaatttgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatatactgagaagttattatctgtagacgagcctagaaatcaacttattcttgataccctggtagaagaattcaagtcaggaactattaatcgaattttagttattactaaactacgtgaacatatggtatttttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaagaaagttatcggaaacatcaagaatccgattccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacttttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggatattacattttcttaccgctatattttggaagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaattaggaaaaaagatattagtaaaagatgtagaccatttaatacgatctaaggttagagaacatacatttgtaaaagtaaaaaagaaaaacacattttccattttatacgactatgatgggaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatagaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgaatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctagaagtgttggattttatccggatcaagtaaagatttcaaaaatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagttgcttctcttaatccaaatatgatatgtgattttgtaactgactttaaacgtagaaaacggatgggattcttcggtaacttggaggtaggtattactttagttagggatcacatgaatgaaattcgcattaatattggagcaggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggacaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcatttaaattcgaaattgtccgatgaagaattgtcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttaaaagactcagaagaggattatcaagatgtgtatatttgtgaaaattgtggagacatagcagcacaaatcaaaagtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggtcgttatttcgtcggacgtctgatattcggaaatctgtggagtttcaggttttggtggaggtgtaactgctacttgggatactgaagtctgatattcagaaagctgggggatgttctggttcgacatccaccgatggtgtcacatcactaatcggtttggtaacgtctgtggatggaggtgctacttctacagaacctgtagcctcagttgtcaacggagatacattttcaatgcaaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttccagatcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttcttttgaattcacagctggatgtacaaccgtttcctccgtttccattaccgccatctctaagtttcttttctagatcggcaatctttctcaacatttcatccccatgccttttacattcctcgagtctactgtcgtcgaaatatcgttccagctccttttcgacatcaataactttagcacgttgtctctcaagctctcttttgtagtaactatcatttttatctgattccctggcacgtttaagatcttcatgcaattgagtcagctcttaacacaatctcttaacttcctctcttgcttcttcgtcatagtacttacaatcactatgggatccattgttaccacgtctacactcggcgagctcgcgtttaagagattcaattttccgtttgtattggtccatgtctccattgctaccaccattagatttacaggctgctagttgtcgttcgagatcagaaatacgggttttcttgaattgatttcgtcgatgtacttggcatgattggcatcgaaacacttattaagttctttttccaattctacgattttatttctttcgcaagtcaattccctcctgtagtaactatctgttttgttagattcacgctctctacgtagactttcttgcaagttactaatttgttccctagcacgtccgagttcagttttatatgccgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattctagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcttactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgttatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcatttaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaagaatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaagaggaaatattcagtatatagatatgccttagcatcatatcttgtactaaacacgctaaacagtttattgatgtgatcaatttccaacagaataattagagcagcgggaataccaacaaacatattaccacatccgtattttctatgaatatcacatattatgttaaaaaatcttgatagaagagcgaatatctcgtctgacttaatgagacgtagttcagcagcagcataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcaaaactcaactcatcgttccatagtttttttacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatggaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcaggatcgtatatataaggagtaccatcgtgattcttaccagatattatacaaaatactatatataaaatatattgaccaacgttagtaatcatataaatgtttaacgttttaaattttgtattcaatgatccattatcatacgctagcatggttttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttaaatatacttttaattgaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaattaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggttggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagctgatagcaattcatgtactacggataatgtagacgcgtattgcgcatcgatatctttattattagataaatttatcaataaatgtgagaagtttgcctcgttaaggtcttccatttaaatattatataaacatttgtgtttgtaacttattcgtcttttatggaatagtttttaactagtaaagctgtaattacatactttgtccgtaaaacataaatataaacacccgcttttatcaaacgttccaaaaagtcgacagcggacatttttaacatggcatctattttaaatacacttaggtttttggaaaaaacatcattttataattgtaacaattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataataattataataattataattattataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatttcgatatttcaatcatggactttataggaccatacattatatgtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaaggtaaacatcagccattttatctattcccatctattgatgtttttaacgctacaatcatagaagcgtataacctgtatacagctggagattatcatctaatcatcaatccttcagataatctgaaaatgaaattgtcgtttaattcctcattctgcatatcagacggcaatggatggatcataattgatgggaaatgcaatagtaattttttattataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacatgaacacgatgatatagaatcatcggttgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtatttattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgatcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaatactgctacaaatgaaaaaaaagctattatcaaatactgtacggaatggattcattctcttctctttttatgaaactctgttgtatatctactgataaaactggaagcaaaaaatctgataaaaagaataaaaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgatggataaaacaaaaatgccccgcataactctatcatggcaataatacaaccaaacacttgtaaaattcctaaattagtagaaaatacaactgatatcgatgtataagcgatttcgaggaataataaaaacaaagtaatgcccgtaaagataaacatcaacattgtttggtaatcattaaaccaattagtatgacgttgaactaatttcacagtaaattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttgtccaatttccatctaatatactttgtcggattatctatagtacacggaataatgatggtattattacatgctgtatactctatagtctttgtagatgttataatcataaaagtacagaggtatatcaacaatattctaactcttaacatttttatttatttaaaatgatacctttgttatttattttattctattttgctaacggtatcgaatggcataagtttgaaacgagtgaaaaaataatttctacttacttaatagatgacgtattatacacgggtgttaatgggggggcagtatatacattttcaaataataaactaaacaaaactggtttagctaatactaattatatcacaacatctataaaagtagagaatgaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacaaaggtggtccatcatcgttgtctagtcatagatggtcgacgtttttcaaagtcgaattagaatgtgacatcgacggaagaagttatagacaaattattcattctaaaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgtttcacataccacgtttgacgttatagaacaatataatgtactagatgatattataaagcctttatctaaaccaacctatcttcgaaggaccgtctggcgttaaatggttcgatataaaggagaaggaaaatgaacatcgggaatatagaatatacttcataaaaaaaaattttatatattcattcgatacaaaaactaaacaaactcgcagtgcacaagtcaatgcacaactattttcagtaatggtaactgcgaaaccgttatttatagcagatatagggataggagtaggaatgccacgaatgaaaaaatacttaaaatgtaatcttaattcgagtacaccacacgacaatgaacaaacctaagacagattatgctggttatgcttgctgcgtaatatgcggtttaattgtcgaaattatttttacagcgacactattaaaagttgtagaacgtaaattagttcatacaccatcaatagataaaacgataaaagatgcatatattagagaagattgtcctactgactggataagctataataataaatgtatacatttatctactaatcaaaaaacctgggaggaaggacgtaatacatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaactaaacatatgaacggaactaaaaaacggaaatatatttgtagtacaacgaatactcccaaactgcattcgtgttacactatataacaattacactacatttttatcataacactacttcggttagatgttttagaaaaaaataaatattgccgtactgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcaccatatttatggattttggattcacacgttgtttgtctgaggggttcgtctagcgttgcttctacataaacttctattcccatatattctttattgtcagaatcgcataccgatttatcatcatacactgtttgaaaactaaatggtatacacatcaaaataacaaatactaacgagtacattctgcaatattgttatcgtaattggaaaattagtgttcgagtgagtcggattatgtgagtactggattgtatattttattttatattttatattttgtaataagaataaaatgctaatgtcaagtttattccaatagatgtcttattaaaaacatatataataaataacaatggctgaatggcataaaattatcgaggatatctcaaaaaataataagtttgaggatgccgccatcgttgattacaagactacaaagaatgttctagcggctattcctaacagaacatttgcaaagattaatccgggtgaagttattccgctcatcactaatcataatattctaaaacctcttattggtcagaaattttgtattgtatatactaactctctaatggacgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgaaatggataatatccatattgacgatgttaataatgccggtattggcatacagttcatcgatttttagatttcattcaaaggatgtggaattatgttatgggaatttgtattttgataggatctataataatgtagtaaatataaaatatattcctgagcatattccatatagatataattttattaatcgcgcgttctccgtagatgaactagacgataatgtcttttttacacatggttattttttaaaacacaaatatggttcacttaatcctagtttgattgtctcattatcaggaaacttaaaatataatgatatacaatgctcagtaaatgtattgtgtctcattaaaaatttggcaacgagtacatctactatattaacatctaaacacaaaacgtattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtggaagaaaaaaatattatcgatattgaagatgacgatgatatggatgtaaaaagcgcgtaatactatctataaacataagtatataataaatactttttatttacggtactcttgtagtggtgataccctactcaattatttttttaaaaaaatacttattctgattcttctagccatttccgtgttcgttcgaatgccacatcgacgttaaagataggggagtagttgaaatctagttctgcattgttggtacgcaccttaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctcttaccttatcaaagtcgtttatatcacattgtatatagtttataaccttaaccttcgaggttattggttgtggatcttctacaatatctatgactctgatttcttgaacatcatctgcactaattaaaagttttactatatacctgcctagaaatccggcaccaccagtaaccgcgtacacggccattgctgccactcataatatcaaactacttattctattttactaaataatggctgtttgtataatagaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataatttttttatagcgtgaaggatatgataaaaaatataattgttgtatttatcccattccaatcaccttatatgattctgtaaaaaaattatactgtaacacaatgaaggagtcttatagatgtatagaggtcagatactggtttgataaactgtttattccacataagtatgtttgactttatggttaaacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagcttatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccaatatgcataccgaactcgtatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgtagaagtactcggttccaaaatagcggatatagatattaaacaagtgatacgtgagaatatactacaattgtctaatgatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaattcatctaaacaaaatctagactttatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaaaaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaaggaagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatttaaacgatttagtaaacttgactaaatcttaatagttacatacaaactaaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagttaagaacgtttacatcgacggacaatctaaaaacaatacagtgattgcagatttgccatatctggataatgctgtatcggatgtatgcaaatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatttcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggctatagctactacgtttacggtatagcctctagataatttttttaagcacgaaataaaaaacataattttaaaccaatctattttatactattttgtgtaatcaccatggacataaagatagatattagtatttttggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcataaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagctattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccacacgctccggtaaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccgcaatcccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattatgattatgattttgattttgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatctataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgataaatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcaacgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgtcatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccatcaactactgtaggtagtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggtttaggaaagacagccatagccaaaagactgttaaaagactatgggaatatatttggatttgtggtgtcccataccactagatttcctcgtcctatggaacgagaaggtgtctattaccattacgttaacagagaggccatctgaaagggaatagccgccggaaactttctagaacatactgagtttttaggaaatatttacggaacttctaaaacagctgtgaatacagcggctattaataatcgtatttgtgtgatggatttaaacatcgacggtgttagaagttttaaaaatacttacctaatgccttactcggtgtatataagacctacctctcttaaaatggttgagaccaagcttcgttgtagaaacactgaagctaacgatgagattcatcgtcgtgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttattacgtgcaaggcatttggtctatacaaatccattaatgtggaatatagattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaacggcgaacatgttccatttataagaaatccaaataaaatggataacggtactctagaatttacacctatagattctcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcaactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgttgataaaaattaaaaaaataacttaatttattattgatctcgtgtgtacaaccaaaatcatggcgatgttttacgcacacgctctcggtgggtacgacgaaaatcttcatgcctttcctggaatatcatcgactgttgccaatgatgtcagaaaatattctgttgtgttagtttataataacaagtatgacattgtaaaagacaaatatatgtggtgttacagtcaggtgaacaagagatatattggagcactgttgcctatgtttgagtgcaatgaatatctacaaattggagatccgatccatgatcaagaaggaaatcaaatttctatcatcacataccgccacaaaaactactatgctctaagcggaatcgggtacgagagtctagacttgtgcttggaaggagtaaggattcatcatcacacacttgaagcaggaaacgctgtatatggaaaagttcaacatgattattctactatcaaagagaaggccaaagaaatgaatgcactcagttcaggacttatcatcgattaccacgtctggataggagattgtatctgtcaagttactgctgtagacgtacatggaaaggaaattatgagaatgagattcaaaaagggtgcggtgcttccgatcccaaatctggtaaaagttaaacttggggagaatgatacagaaaatctttcttctactatatcggcggcgccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaattaattgagagattggtagaggagttcttcaatagatcaaaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactggtagagaatgatatagaaaagcatatcaaaagactttgtgttgtgcatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtagttatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattgatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttattctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaatagattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactgtccacatatctaaaaatcttataaacattattaaaatataaaatctaagtggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgtgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgctttgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtctttttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacactcaatggtataatgatgaatgaacgcgatgtttctgtaagcgttggcaccggaatactattcatggaaatgtttttcgattacaataaaataattcaaaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaataacaataacagacaacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacaacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacaaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaattctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatacagatacagatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtgaaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatatttaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatcaactgctgaacagctatcgaaatatgtagaaaaggaggagaacatggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacagaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacaattgtattccacactcctctcttttagagatgatgcggaatcagtgttcatcgacattcgcgagctggtaaaaaatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctcccttcctccctcttctccctttcccagaaacaaactttttttacccactataaaataaaatgagtatactacctgttatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggacaccgacgtcttttggataagtaatggtatgtattacaaagaagatgatggggacggaaacggtagaataagtgtagcaaataaaatctatatgaccgataagagacgtgttattacatcccggttaaacattaatcctgttaaggaaaaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgttacatcctttattaaatcattaatgggaatttctatgtcatagttaatatattgtgaacaacaagagcagatatctataggaaagggtggaatgcgatacattgatctatgtagttttaaaacacacgcaaactttgaagaatttatataaatcattccatcaatacatccttctatgttgagatgtatatatccaggaattcgtttattaatatcgggaaatgtataaactaaaacattgcccggaagcggagcttctaccggagttatatcagtttttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaaccgaatcacctaccttagatacccaattacattttatcagatccagataataaacaaattttgtcgccctaactaattttatattgttatatattttacaattggttatgatatcatgtaataacttggaatctaacgcacatcgtcgtacgtttacacaattgtgatttagtgtagtatatctacacatgtatttttccgcgctatagtattctggactagtgataaaactatcgttatatctgtcttcgatgaactcatcgagatattgctctctgtcatatttatacacctgcataaactttctagacatcttacaatccgtgttattttaggatcatatttacatatttactggtataaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacatattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatattgtatccacctaccaaagtatagttgtatttttctcatgcgatgtgtgtaaaaaaactgatattatataaatattttagtgccgtataatgaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtattttatcgcacagatataaagactatgtggttaaatgggaaaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctatagaatgaatgaggatacgcgactatctaggtatttgtatctcactgatagagaacatataaatatagactctattaaacagttgtgtaaaatatcaaatcctaatgcatgttatagatgtggatgtacggctttacatgagtacttttataattatagatcagttaacggaaaatacaagtatagatacaacggttactatcaatattattcatctagcgattatgaaaattataatgaatattattatgatgattatgatagaactggtatgaacagtgagagtgagagcgagagtgataatatatcaatcaaaacagaatatgagaatgaatatgaattctatgatgaaacacaagatcaaagtacacaactagtaggttacgacattaaactcaaaaccaatgaggatgattttgtggatgaattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaatcaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcttaattacatgaagttattagtgtataacggaaatgatataaacgcacgaggtgaagatacacaaatgcgaactccattacacaaatatttgtgtaaatttgtatatcataatattgaatatggtgtccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatatcattaaagacagacgatggtaaaactgtatttgatttatcgttatgtagttacatccctcttaaatggactagctttttgattagtcgtctaccgcctaaaagtgtcatatgctcactgactaaccatataatagattatgttcttacgaacaatagacgtattatttggcagagtcaaatgattaataagtacgtactgttactggacccatccttttattctagatttagaaatgctatcgaaagcaaattaaaccaacacgctaatcgttataataggttcgaacacgatagagatcgcgttaatgaaaattatgacaaagtcttacatgacatagacatatatattaaggatgtacaaatattaaaatctatttccatcactaataatataacactatacgatactattataaataagtcagagtttcctatacgtcgtgcaaatgacaaacaattaattaataaaataaaatccaatatatatcataatcttatcgaaaaagttattaaaaatgcattagagaaatgcactctgactaatgccgtcctcgagtatatgatgtcatctcgatctcaatcatcttatttgagtcgtattcctaatgagatattactcgaaatattatataaactcgacatgtacgatttacgtaatctatatacaagatatatgagagagaatgatatcacagagtatcatatagagaatacgaggtctgtttctacacagacatgaataatgaatacacactacaacgtttttttttaaaatcttagatataacactaaaattacatcaagattataatattgaaatcgtaatttgagttgtttgataatcatggatatcaaaaatgatatacgtaacattagcaatcttttagatgatgatatattatgcgatgtaatcataactatcggagatggagaagaaattaaggcgcataaaactatcttggctgccggatctacgtattttaaaacaatgttcacgacacctatgatagcgagagatctagtaactagagtaaatctacagatgtttgataaagatgtcgttaaaaatattgtacagtacttatacaataggcatataagttctatgaatgtaatagacgtattaaaatgcgccgactatcttctaatcaatgatctagtcactaactgtgaatcctatattaaagattatattaatcatgatatataccataagttatatgagatggttcatattccaatagtcaaatatattaaacgtatgctgataagtaatataccaacattgataactacgaacgcatttaaaaaaacagtatttgaaatattattcgatattatttctactaacgacagtgtatatttatacagagaaggatataaagtgacgatactattgaagtggctagaatacaactacatcaccgaagaacagctgttgtgtatactgtcctgtatagatatacaaaatctagataaaaagtctagactactactctattcgaataaaactataaatatgcatccttcgtgtatacaatttctattagataataaacagaatagaaacattataccccaccagttatgtttagcgtgtcatgatactaactataatgtatgtaacccgtgtatagtagtgtataacattaatactatggaatatagtgttatttccaccattcctaatcacataattaattacgcatccgcaattgtagataatgacataataatagctagaggatataactttaataatccatcattaaacaaggtatataaaataaacattgagaacaaaatacatgtagaactcccacccataataaaaaatagatgtcgtttttcattggctgtaatcgatgacacaatttatgctataggtggtcaaaacggtacgaacgtagaacgaactatagaatgttatacaatgggtgatgataagtggaagatgttacccaatatgcccatagcattatctagttatggcatgtgtgtattagatcaatacatatacattataggcggtcgtacccaacacattgattatacatcagtgcatacagtaaatagcatagatatggaggaggatacaaatatttcaaataaagttatgagatacgacactgtcaataatatatgggaaacattacctaacttctggactggaactataaatccaggcgtggtctcgcataaagatgatatatatgttgtatgcgacatcaaagatgaaaaaaatgttaaaacttgtatatttagatataacacgaatacgtataacggatgggaattggtcacgacgacagaaagcagattatcagctctgcatactattctttataacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttatcgttatcgttatcgttatcgttattgtttggtctataccatggatatctttaaagaactaatcttaaaacacacggatgaaaatgttttgatttctccagtttctattttatctactttatctattctaaatcatggagcagctggttctacagctgaacaactatcaaaatatatagagaatatgaatgaaaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatagtacgaaggtctacataaaccatccatttatgtacatgattaaagacaacacaggacgtatactttttatagggaaatactgctatccgcaataaatataaacaaatagacttttatcacgtttatctatgtctaaatattacaaatagtaatagtataaactaaagctgataatacattaaaacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaatagatttccagatatggcttattatcgaggagactgtttaaaagccgtttatgtaacaatgacttataaaaatactaaaactggagagactgattacacgtacctctctaatgggggttgcctgcatactatcgtaatggggtcgatggttgattattgattagtatattccttattctttttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtatctacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtaactccatcaccaactccaacatatgcacatgtaacaactcctcttccaacatcagcagttccttatgatcaacgatcgaataacaatgtaagcactatatctattcaggtactgagtaaaatattgggagtcaatgaaacagaattaactaattatcttattacgcataaaaatgccacggttgacaataacaccatggtcaatgatgaaacatctgacaataacacattgcatggtaatataggatttttggaaataaataattgttacaatgtttctgtatcagatgctagttttagaataacattagtaaacgatacttctgaagaaattttgctaatgctaacaggaactagttcatccaacacctttatatcttccaccaatatcactaaatgtttgaaaacattaatcaataatgcgtcaattaatgatgtacttataacacaaaatatgaatgtaacatctaattgtgataaatgctcaatgaatttgatggcatccgttattcctgcagttaatgaatttaacaatacgttgatgaaaattggtgtaaaaaatgatgaaaacaatacggtatataaatattataattgtaaactaactacaaattctacgtgtgatgagttaatcaatttagatgaagtcattaacaacataactctaacaaatattatacgcaatagtgtttcaataactaacagcaggaaaagacgagatttgaatggtgagtttgaattttccacttccaaggaattagattgtctttacaaatcatatggtgtaaacgaggatgtaagtcattgttttgcatcacctagacgtaaacgatctgacgacaaaaaggagtacatggacatgaaattattcgaccacgcgaaaaaagatttaagaatagacagtgttattcctaaaggtacaactcatttccaagtaggtacatctggtgcaagtggtggtgttgtaggagataggtccccatttcaaaatgttaaatcacgtgcaagtctattggcggaaaaaataatgcctagagtacctactactgctaccgaagagcagctatatgcaactgtaaataaacaaaccaagttgcctgcaggtgttaaaagtactccgtttacagaggctcttgtgtctacgataaaccaaaagctttctagtgctaaagaggtaacttatgcttcgctcaatctgccaggatcaagtggctatgttcatagaccatctgattctgttatttacagcagtataagacggtcacgtttacctagtgatagtgatagtgattatgaagatatacaaactgttgttaaggaatataatgaaagatatggtagaccagtcagtaaaacacagttatcaagtagtgaaagtgattttgaagatatagatactgttgttagagaaattaaacaacaaaaatatggtggagctagccgtgttagaacatcatcaagtagtagtgattttgaagatatgaatactgttgttagggaatatagacaaaaatatggcaatgcaatggcaaaaggacgtagtagttcccctaaacctgatccattatatagtactgttaagaaaacaactaaaagtctatcaggtggtgtagacatagttacaaaacaatcagactattctctattacctgacgttaatactggtagttctattgtgtcacctctcaccagaaaaggagctactagacgccctacaaatgatggtctacagagtccaaatcctcctccccgtaatccccgtcgaccacttcctcaacatgatgattattctcctccacaagttcctcagcgcgattattctcctccgcgcagacctccgccacttcctcctaaaccagtccaaaatccgccacgacttccccctagaccagcaggtcaattacctcctatagatcaaccagataaaggatttagtaagtttgtatcacctagacggtgtagaagagcaagctctggagtcatatgtggtatgatacaatcaaaaccaaacgatgatacctatttacttcttcaacggccaaaacttgaaccagaatatgcggaggtcggtaatggtatacccaagaacaatgttcctgtaataggtaataaacatagtaaaaaatatacatcggcgatgttaaaaatatcaacaaaatttgataaatctacggcatttggagcagcaatgttactaactggtcagcaggccattagccaacagactagatcaactgcgttaagtagaaaagatcagatgagcaatgaagaaaagatattcgaagcagttacaatgagtctatcaactataggttcaacgttgacgtctgcgggtatggcgggcggtccaaaactaatgattgcaggaatggctataacggctataactggtataatagatacgataaaagatatatattacctgttttcaggacaggagaggccggcagatcctgttattaaattatttaatacatacgctggcttattatccgatagtaataaaatgggggtaagaaaatgtttgacgcccggtgacgacacacttatttatattgcatacagaaacgatagcagttttaaacatagtacggatgcgatggctttgtatttcttagatgttatcgactcagagatcctatatctaaacacatcaaatttagttctagagtatcaactaaaggtggcttgtcccataggaacattaagatctgtagatgtggacataactgcgtatacaatattatatgatacagcggataatattaagaaatacaagtttatcagaatggcaacgctactatccaaacatccagttattagattgacatgtggtttagcagcaacattggtaattaaaccgtacgaggtacccattagtgatatgcaactactaaaaatggcgacgcctggtgaaccagaatccactaggtctataccatctgatgtctgtgataggtatcctctaaagaaattctatcttttggctggtggttgtccctatgatacatctcaaacttttattgtacatactacttgcagtattctactaaaaacagctacacgtgatcagtttagaaacagatgggtgttacaaaatccatttagacaagaaggggaatataagcaactgtttacctttagcaaatacgattttaacgacaccataatcgatcctaatggtgtggcgggtcatgctagcttttgtaccaataaaagcagcaaccaatgtttctggtccgaacctatgatattggaagatgtatcatcgtgtagttctagaactagaaaaatatacgtaaaactgggaatatttaatgctgaaggttttaatagttttgtactaaactgtccaactgggtctacacctacatacatcaaacataaaaatgcggacagtgacaatgttatcatagagctacctgtaggtgattacggcacagccaaattgtattcagcaacaaaaccgtcgaggatagctgtgttttgcacacataactatgataaacgattcaaatcagatattatagttctaatgtttaataaaatcagcggtgttccattttggagcatgtacacaggaagtgtaactagtagaaatagaatgtttaccacattgtctagaggaatgccgtttagatcaacgtattgcgataacagacgacgatcaggttgttattatgcaggaataccatttcatgaagatagtgtagaagcagatctacattatggaccaaaaataatgttaaaggaaacatatgacacaaacagtattgacccacgagttataacaaagtcaaagacgcactttcctagtccaataagtgtaaaattcatggctgacaatttaggaaatggatatgacaaccctaattcattttgggaagatgctaaaactaagaaacggacatatagtgcaatgacgataaaagttctaccatgtacagtgagaaataaaaatatagactttggatataactatggagatattatttctaatatggtttatctacaatctactagtcaggattatggagatggtaccaaatatacatttaaatccgtaactagatcagatcatgagtgtgaatctagcttagatctgacgtctaaggaagtaactgtgacatgtcctgcgtttagtataccaagaaatatatcaacgtatgaaggtctatgctttagtgttactacatctaaagatcattgtgctacaagtaataatgggttaaaatcttctggctatggaaaggaagatgctgttaaaccacgtgcctgctttcatcattggaattattacacactgtcgttggattattactgttcatacgaagatatttggagaagcaactggcctgactatgatccatgtaagtcatatatccatatagagtatagagatacatggatagaatctaacgtgttacagcaacctccttacacatttgaattcactcatgacaattctaacgaatatgtggataaagaaattagtaacaaattaaatgatctgtacaatgcatacaagaagattatggaatatagcgacggatcattgccggcgtctataaacagattagcaaaagcattgacttcagagggtagagaaatagcaagtgttaatatagatggtaatctgttagatatcgcatatcaagcagataaggaaaagatggccgacatacagacaaaaataaatgacatcaccagagacttatttatgcacactctatcagacaaagatataaaagacattatagaatccgaagaaggtaagagatgttgtataatagatgttaagaacaatcgtgttgaaaagtactatcctattgataattatctatgtggtactttagatgattatatatacacctctgtagaatataacaaatcctatgtgttagtaaacgatacttatatgagctacgactatcttgaatcatcaggtatagttgttctatcatgttatgaaatgactataatctccttggatacaaaagacgccaaagatgctatagaagatgtgatagtagcaagtgcggtagccgaagcattgaatgacatgtttaaggaatttgataaaaacgtaagtgctattataataaaagaagaagataattatctaaacagttcgccggatatctaccatataatatatatcataggtggcactattctgctactgttagtcattattttaatattggcaatttatatagcgcgcaataaatacaaaaccaggaaatataaaataatgaaatatgacaataggagcattaaatctgagcatcatgatagtcttgaaacagtgtctatggaaattattgataatcggtactaataaaatagtttaactcttttaaaaccagtttggtactggaatttcagttcattactcgttgagaaattgatgatttttttaaaatgatattacttttatatgcttgcatcgcagaatgatattcacaagtattattaaaaatgagtatcggtagttacattaccatatcatccatgctcatatggatctccatccattatataatcaatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatactttaaatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacagtgatggtcacattccattacacaaatatttaactcatgatgaagttgagaatgatatctttgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgatattaataaagtaaataatataggaaatacacctctacataactacgtatctcaatatgatatcactctcattcctcatccacaacccattaaaaaaatggaaattaaagccctctattagcatagacggctacaggtctaccatcaggttaaccttcgtctacctttacaatggcctttccttgtgcccagttcagaccctgtcattgccacgctactaaggactccctgtataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggagttctcggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgaaaacgactatctcaccctcttggatcatatccgcactgctaaatactaaatctccttcatgctctctcactaatactcttactttctcactcactcactcactacactttttatcacacccaccttactttttatcatcttatgaggaatgattgccttcatcatttttcgtgaaatataatataggaataattagcaccagaatagctatggattgcgtcagagattgcacatgtattctatgtcgtctactggatgaagatgtgacgtacgaaaaaataaaactagaaattgaaacgtgtcacaacttatcaaaacatatagatagacgaggaaacaatgcgctacattgttacgtcttcaataaatgcgatacagacattaagattgttcggctgttactctctcgcggagtcgagagactttgtagaaacaacgaaggattaactccgctaggagtatacagtaagcatagatacgtcaaatctcaaattgtgcatctactgatatccagctattcgaattcctctaacaaactcaagtcgaatataaatgatttcgatctgtattcgtatatgtcttcggataatatcgacttacgtctgctaaaatacctaattgtggataaacggatacgtccgtccaagaatacgaattatgcaaacaatagtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgacgtcagtcagccctatattagaggcgtattagcggattatctaaacaagcgatttagagtaaccccatataatgtagacatggaaatcgttaatcttcttattgagagacgtcatactcttgtcgacgtaatgcgtagtattacttcgtacgattccagagaatataaccactacatcattgataacattctaaagagatttagacaacaggatgaatccatcgtacaagccatgttgataaactacttacattacggcgatatggtaagtatacctatcgttcgatgcatgttagataacggagcgaccatggataagacaacggacaacaactatcctctcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagcagttaccaaagagaaaacaaaacgaggatagttgatttattacttagctaccatcccactctagagactatgattgacgcatttaatagagatatacgctatctatatcctgaaccattatcggcatgtatcagatacgccttaatcatagatgatgattttccttctaaagtaagtatgatatcgccggtcatcataaggaactaaagcgctatagagtagacattaatagaatgaagaatgcctacatatcaggcgtctccatgtttgatatattatttaaacgaagcaaacgccacagattgagatacgcaaagaatccgacatttataaactttgtatccaacatcaaatggtacaaaaaagaactaacgtccatcattacagaaactgtaaagaacaatgagaggatcgactccatagtggacaacattaatacagacgataacttgatttcgaaattacccatggagatacaactcgagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaatatattgttcggttttctttttctttcacatctttaattatgaaaaagtaaatcattatgagatggatgaaatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgactaaaatgtggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaattattgactaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgcggttacaaaaatcggaaatacgccgttacacacttaccttcaacagtataccaaacatagtcctcgtgtggtgtatgctcttttatctcgaggagccgatacgaggatacgtaataatcttgattgtacacccatcatggaatacataaagaacgattgtgcaacaggtcatattctcataatgttactcaattggcacgaacaaaaatacgggaaattacaaaaggaagaaggacaacatctactttatctattcataaaacataatcaaggatacggaagttacactctcaatatactacggtatctactaaataggttcgacattcagaaagacgaatactataataccatgactcctcttcataccgcctttcaaaattgtaacaacaatgttgcctcatacctcgtatacatcggatacgacatcaaccttccgactaaagacgataagacggtattcgacttggtgtttgaaaacagaaacatcatatacaaggcggatgttgtgaatgacatcatccaccacagactgaaagtatctctacctatgattaaatcgttgttttacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgaaaaatgcagtcgtgacataagtcgccttaaagagattcgaatctccgacaccgacctgtatacggtattaagaacagaagacatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcataaccaagctaagcgactatcatctaaacagtatgttgtacggaaagaaccattacaaatattatccatgatagaaagaaaatatttaaaaaatatctatataattggagaagtaggaaacaagaacaagacaacgattactacattattaaattatgaagtccgtattatacttgtatatattgtttctctcatgtataataataaacggaagagatatagcaccgcatgcaccatccaatggaaagtgtaaagacaacgaatacaaacgccataatttgtgttgtttatcgtgtcctccgggaacatacgcttccagattatgcgatagcaagactaacacacaatgtacgccgtgtggttcgggtaccttcacatctcgcaataatcatttacccgcttgtctaagttgtaacggaagatgcgatagtaatcaggtagagacgcgatcgtgtaacactactcacaatagaatctgtgaatgctctcccggatattattgtcttctcaaaggatcatccggatgcaaggcatgtgtttcccaaacaaaatgtggaataggatacggagtatccggacacacgtctaccggagacgtcatctgttttccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgtaatcccgtatttcgtgaggaatacttctctgtccttaataaggtagcaacttcaggtttctttacaggagaaaatagatatcaaaatatttcaaaggtgtgcactctgaatttcgagattaaatgcaataacaaaaatttttcctccaaacagttaacgaaagcaaagaatgatgacggtatcatgccgcatttggagactgtaactctagtgggcgactgtctatctagcgtcgacatctatatactatatagtaataccaatactcaagactacgaaactgatacaatctcttatcatgtgggtaatgttctcgatgtcgatagccatatgcccggtagttgcaatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcaatcattttcatcctcatcctcgtgtacggaagaagaaaacaaacatcatatgggaattgatgttattatcaaagtcacaaagcaagaccaaacaccgaccgatgataagatttgtcaatccgtaacggaagttacagagaccaaagacgatgaggtatccgaagaagttgtaaaaagagatcccaccacttattacagtatcgttggtgcgggtcttaacatgaactttggattcacaaaatgcccaaagattttatccatctctgaatcctctgacggaaacacggtgaatgctagattgtccagtgtgtccccaggacaaggtaaggactctcccgcgatcactcgtgaagaagctctggctatgatcaaagactgtgaggtgtctatcaacatcagatgtagcgaaaaagagaaagacagcgacatcaagacccatccagtactcgggtctaacatctctcataagaaagtgagttacgaagatatcatcggttcaacgatcgtcgatacaaaatgcgtcaaaaatctagagtttagtgttcgtatcggagacatgtgcaaggaatcatctgaacttgaggtcaaggatggatttaagtatgtcgacggatcggcatctaaaggtgcaaccgataatacttcactcatcgattcaacaaaactcaaagcgtgtgtctgaattgataactctattcatctgaaattggataagtagggttaatcgaacgattcaggcacaccacgaattaaaaaagtgtaccggacactatattccggtttgcaaaacaaaaatgttcttaactacattcacaaaaagttacatctcgttacttcttctttttctgtctcaatatgtgatacgatatgatcactattcctattcctattctctcttcgatggtctcataaaaaaagttttacaaaaatatttttattctctttctctcttcaatggtctcataaaaatattaaacctctttctgatgtttcaactatttcgtaaacgataacgtccaacaatatattctcgtagagattatcaatatccctatgcccatctaggttactagacaattgcatcataaaataatgtttataatttacacgttaacatcatataataaacgtatatagtataatattttttggcatataaatgatctagtaaaatccatataggggatactgctcacgttttttctttggtacaaaatttcacacaagtttttatacagacaaatattctcatccatatattttaaaacattaacttttgtactaagaaaaatattaaacctctttctgatggagtcgtaaaaaagttttatctctttctccttcgatggtctcacaaaaatattaaacctctttctgatggtctctataaagcgattgatttttcttaccctctagagtttcctacggtcgttggtcacacatttttttctagacactaaataaatagtaaaatttaataaa

SEQ ID NO: 50 - DNA, 18073 bp, Vaccinia virus
agagagaaagagaataaaaatatttttgtaaaactttatttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggattgctgaagactggcaggcacatgcatgccaggacgatatattgtttcatgattgctattgattgattactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgatagtatcattctttgctttcgttaactgtttggaggaagaatctttgttattgcatttaatctcgaaattcagagtgcacacctttctcctgtaaagaaacctgaagttgctaccttattaaggacagagaagtatccatcacgaaagacgggatcgcagtctttatgattcatagtaatagttagttccgacgttgagatggattcgctgagaccggtagtggtcgtccgagtacacgatgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcatcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattggccatcgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattataatattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaacggcgttaatgtttgctccataatctattatcgcgtagatgaatcgcttctcggctcgcatcttagtgtgacttgacttgtaataattgcttttgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcaatctgtggcgtttgcttcgtttaaataatatatcaaacatggagacgcctgatatgtaggcattcttcattctattaatgtctactctatagcgctttagttccttatgacgaccggcgatatcatactttactttagaaggaaaatcatcatctatgattaaggcgtatctgatacaggcgaataatggttcaggatatagatagcgtatatctctattaaatgcgtcaatcatagtctctagagtgggatggtagctaagtaataaatcaactagcttcgttttgttttctcttctgtaactacttttctggatggccgtattgattatcgagcgtgatgttgtaacactcgctccatattccaataaccgctttgcaaattgtatattattgacatcgaccgcgtaatatagtagagttttattctcattatcgatcatatctatattatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaattcgaatagctggatatcagtagatgcacaatttgagatttgacgtatctatgcttactgtatactcctagcggagttaatccttcgttgtttctacaaagtctctcgactccgcgagagagtaacagtcgaacaatcttaatgtctgtatcgcatttattgaagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagaggccctgcagtttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctgcataattagggtctgctccttttcttaacaacttatacagtacgtagtagtttatcggttttaaatcaagtctagaatatatagtggattaatatatttttatattagctaaagctatctatactatcagaaagcatatcattctcaacttcatcatgagttaaatatttgtgtaatggaatgtgaccatcactgtcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctagaataggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcatggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatggaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattacataccattaataatgcaagcataaaaaatcgttagtagatgtttctaaatataggttccgtaagcaaagaatataagaatgaagggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattatgtgttgtctattatctgtttataggttcactcgacgaactaaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagttattgatctattatatgaaacggatatgtctagaacggcaattgtcttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgatttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatatcataaataaaaatagtagcacacaactacttcagcaaacattctttttataaatgccatctatcgtagtgaggacacaagtgaacctataatgagcaaatttattagtatcggttacatgaaggactttctgtagagtgacgattctaccatctatggtacgaacggtttcatcttctttgatgccatcacccagatgttctataaacttggtatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaggcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgaggctttccattctccaaaaacaatttgaccaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttc

SEQ ID NO: 51 - DNA, 24895 bp, Vaccinia virus
tgtttaaattttaccagttccagattttacacctccgttaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgtgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatttacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaacagagaaatcagtttaggaaaaaaaattatctatctacatcatcacgtctctgtattctacgatagagtgctactttaagatgcgacagatctgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttggatgaatagtatgtcttaataattgttattattttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccattatcccaggctatgtttcgtccatcatcgttgcgcagagtgaataattcttttgtattcggtagttcaaatatataatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaattactaaataatatcccacattatcatctgttagagtagtatcattaaatctattatattttatgaaaaatatatcacttgctcacctctatatttcgtacatttttaaactgtttgtataatatctctctgatatatttattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggctgccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataacttttttgacgaattctacgggatccactttaaaagtgtcataccgggttctttttatttttttaaacagatcaatggtgtgatgttgattaggtcttttacgaatttgatatagaatagcgttcacatatcctccataatggtcaatcgccatttgttcgtatgtcataaattctttaattatatgacactgtgtattgtttagttcatccttgttcattgttaggaatctatccaaaatggcaattatactagaactataggtgcgttgtatacacatattgatgtgtctgtttatacaatcaatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgttttgtattcagatagtacagcgtagtacatagcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcgatagcaatttgttaataagatgcgctaggctcaatgtcttaataagaagtgtaagaggactatctccgaatttgttttgtttattaacatccgttgatggaagtaaaagatctataatgtctacatacttaactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattgtgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcataatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatctagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctccgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatctatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatatatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttggccgggcggagccgaacattctccgatatccaatttctgtatatctataatattattaacctccgcatacgcattacagttcttttctagcttggatactacactaggtacatcatctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagcccc

SEQ ID NO: 52 - DNA, 23297 bp, Vaccinia virus
tctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccgggtacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaataatatacagtcttaaataattacgcaatatctcaatagtttcataattgttagctgttttcatcaaggtttgtatcctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctaaatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatttccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaacccacgtaacattagaattaattatcgatagtaatgcatcaacgcttccaaaattgtctattataaactcaccgataatttttttattacatgttttcatattcattaggattatcaaatctttaatcttactacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacactagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgagaacggacatgctacaaaatatgttcgcggctaatcgcgacaacgtggcgtcgagacttttgaactaaaatacaattatatctttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatatcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcgttctctgaaaattggtaactcattttatatatgctttccttgttgatgaaggataggatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgctatcgcattgtcctcgtgcaaatatccaaacgcttttgtgatagtatgacattcattatctagaaacgctctacgaatatctgtcacagatatcatctttagagaatactagttgcgttaatagtactaaaatttgtattttttttaatatatctcaaaaaaaattaatatttatggatccgatgtataattagaatcagaatctaatgatgacgtacccaagaagtttatctacagccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgttcctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgaccatagattcattcgttatagaatgcatccaatgagtaaaatcaaacacaagatcttctctcctttcaaacttaatcttattagaatattagtggaagaaagattctataataatgaatgcagatctaataaatggaacacaagttgataaaatgttgatagctgaatctgataaatatacaatagatgcaaggtataacctaaaacccatgtatagaatcaagggagaatctgaagaagataccctcttcatcaaacagatggtagaacaatgtgtgacatcccaggaattggtggaaaaagtgttgaagatactgtttagagatttgttcaagagtggagaatacaaagcatacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgataaaacgtttaacgaggacttattcagagttgttgttcaaataaatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagtttgagtttctcatgtctctatataaaggtcctattcccgtatatgaagaaaaagtaaatactgaattcattgctaatggatctttctccggtagatatgtatcatatcttagaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtccattaggacaaatatatgcaaaataatatcgttctccaagttctatagtctctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcaccatttcgacatctggatttcagatataaaaatctgttttcaccgtgactttcaaaccaattaatgcaccgaacatccatttctagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcaatcaatgtgtcaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatag

SEQ ID NO: 53 - DNA, 24971 bp, Vaccinia virus
atattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattttcattaattaaccattccaagtcactgtgtgtaagaagattatattctatcataagcttgactacatttggtcccaataccattaaagaattcttatgatataaggaaacagcttttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatcgatggcattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatctttcggagaacccatatatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatatttttagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggttttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaattaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgagttcccatagctggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgactcactgacattttcacaaatactacaatacggtttaccgaaaataatcaatacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcaaaaatgcaattaaaaatcgataaacttacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgtaaggagattgatgtttcagaagttaaaactttatcatcttatatagatttcgaaaatactaaatcagatatcgatgttataaaatctatatcctcgatttttggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctaatacgtcattaactttattgggtattccgtatggatttggtcataatagaatgtattgttttaaattggtagctgaatgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttcttgctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtaaataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgcggagccgaaaatattgtgtttaatcttccggtgtccaaggtaaaatcgtgtttgtgtagttttcacaatgatgccatcatagatatagaacctgatctgaaaaataatctagtaaaactttctagttatcatgtagtaagtgtcgattgtaacaaggaactgatgcctattaggacagatactactatttgtctaagtatagatcaaaagaaatcttatgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagattaaaacaaaattcgttagaatatatgccacgtttatacatggaatataaaataactacagtttgaaaaataacagtatcatttaaacatttaacttgcggggttaatttcacaactttactgtttttgaactgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggcgatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcagctctagctaccaccgcaatagatcctgttagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaa

SEQ ID NO: 54 - DNA, 26575 bp, Vaccinia virus
atgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaagtatctagcaaagattttatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtattaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccctgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagttttaccttactatcttccagactctaaggatccagaaggaagaggttatattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctatctaaatttcgttgaaccagaggaattgaatcttagtaagtttatgatggttcttccgggggcagccaacaagggaaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtattagatgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagttgtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggactgtatatctcattaagctaatagagcccgtgaatgctatcagtgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatttttgtccttaagactataggtgtcccatcagcatgtagacaaaatgaagatccaagattcgtagaagcatttaaatgcgacgagttaaaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagataatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacaaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttatcaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttatatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttctgtgtcatcgttcaatttatacggatttctatagttctctgttatataatgcggtttgccctcatgattagacaacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcaaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactacaatacgaaattgcaaaatatgctctagatactgcaaaacttaaatgttacggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcat

SEQ ID NO: 55 - DNA, 24635 bp, Vaccinia virus
ttagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagtgattggtgttgtaaggatcctggtcgtagtaagttaaccaacatggtgaattcttgcacactattgacgataggtgtagccgataaacaaatcatcttatggttttttaatgcgatggtcttggataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagaccgatacgtaattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgttgctcctggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatacaatatcttcggtatcttgacgcaatctagtatacatagagttaagagaaattagagtttgtacattgagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttttcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctagccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccattttacacgatgattgtctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgtaactgttacgttcactgcagcattttgaggatttcgagtatgaagtacgatgttattgtttactggtatatctggaaagaattctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaataatagggttagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgattcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtatttcttggttctggaggaggcgaatttaaattcggacttggattcggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataacttagttcacggaaatatcgctatgattggtgtgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgatgtacgttaccaactgcagacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcctggagacgtttcataataatacatataactttcttcggcaaacttaacagctctattatattcaggataattaaaacctaattccatatatttgtctcgtatatctgctattcctggtgctattttaattctattaagagtaacggctgcccccatttttaataatcgtcagtatttaaactgttaaatgttggtatatcaacatttaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggattttgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggaggatatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataa

SEQ ID NO: 56 - DNA, 25934 bp, Vaccinia virus
ttaggtagtaaaaaataagtcagaatatgccctatagcacgatcgtgcaaaacctggtatatcgtctctatctttatcacaatatagtgtatcgacatttttattattattgacctcgtttatcttggaacatggaatggaaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagataatatgcgaagtgcgtgtaacaaagtattagatagtgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagttcggatatacgaaataaaatagacaatggaattcatttgatgtatccagagaggccaattgtcattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctttccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgccgaatagagttctgattcatcctttgagcagatctctagagatcgttcaagatccctgattctagtctttagcctatttacctcctcggaagatgctccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatatttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaacagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttattgatgtgatcaatttccaacagaataattagagcagcaggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaatccaaaatgtatatgttgaacatcactactatcgttgatgagtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatatcatgatatacctgtgacccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctagatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttatccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagcttcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttaaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacccagcaaacgattggtaacatcgtttacaaacgacatactatatgtaaacaatctgtcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgatggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcacatgataatttacacagtaaccaaaatgaaaacactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattctataatcaatgagacatcactatccgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatagcaaagtaacgataatcagttacaacgaatgtgtactatctgacataaacatatcaaaagaaggaattaaacgatagagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgttaaaattccgtatataacacaaatgtgcttaaacgacgaaggtggtccatcatcgttgtctagtcatagatggtcgacgtttctcaaagtcgaattagaatgtgacatcgacggaagaagttatagataaattattcattctaaaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggcgttaaatggttcgatataaaggagaaggaaaatgaacatcgggaatatagaatatacttcataaaagaaaattctatatattcattcgatacaaaaactaaacaaactcgcagtgcacaagtcaatgcacaactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaaatatatttgtagtacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcaccatatttatggatttcggattcacacgttgtttgtctgaggtgttcgtctagtgttgcttctacataaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggacgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccaagtgtattattataataggatatgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaaatacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattt

SEQ ID NO: 57 - DNA, 28801 bp, Vaccinia virus
tacttattctgattcttctaaccatttccgtgttcgttcgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagctgtatgaataatcagatttaccccatttagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccacttataatatcaaactacttattctattttactaaataatggctgtttgtataataaaccacgataatatcagaggagttatttactttgaaccagttcatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgcagaagtactcggttccagaatagcggatatagatattaaacaagtgatacgtgagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattagtacattcttcaaagaaaacacagaaatccgtccaagagataaaagcattttaactttagaagacgtggatagtttcttaactacgttatcatccgtaactaaagaattgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtttttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagttaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgataaatccggtaaatggaagacggttaccaagtgttcaggacacgatgataatacgttaagggagttgcaagaccaattaaagatgattaaaattaacaaggatcccaaaaaaattccagagtggttggtagttaataaaatctatattcccgattttgtagtagaggatccaaaacaatctcagatatgggaaatttcaggagcagagtttacatcttccaagtcacatacagcgaatggaatatcgattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaaaagttaagaacgttcacatcgacggacaatctaaaaacaatacagtgattgcagatttgccatatctggataatgctgtatcggatgtatgcaaatcgatatatatatagtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctcttttggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttttggtgataaatttacggtgactactaggagggaaaatgaagaaaaaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtgtatgtggaaatgtcatagaaagttaaaagttaatgagagcaaaaatatataaggttgtattccatatttgttattttttctgtaatagttaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaaagtttaaaaaaaagattttgttattgtagtatatgataatatcaaaaagatggatataaagaatttgctgactgtatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggtcagatgtagtggtagtgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaacttataattgctaacacgataaattcgtaataatctgttttgttcaaatttttataaggaatctacaggcataaaaataaaaatataatttataatatactcttacaacgccatcatgaatagcagcagtaaattaattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagcgtaaacgatttgatcgattatatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaatattcctagaattaatcccgctctatggtcagcgcataataaattatatgtaggaggaggaatatctgatgatgttcaaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattctattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtgtctatttcaacgtctaatgtattagttaaatattaaaacttaccacgtaaaacttaaaatttaaaatggtatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaagcaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttaatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtaaatcagttaaatttggtaattctattaattgttaaacatatacatctgtttcagctaagcaactaagaacacgtatacggcagcagcttccttctatactctcatcttttaccaagggtggatatttgttcattggagttgataataatacacacaaagtaattggattcacggtgggttacgactacctcagactggtagagaatgatatagaaaagcatatcaaaagactttgtgttgtgtatttctgtgagaagaaagaggacatcaagtacacgtgtcgattcatcaaggtatataaacctggggatgagactacctcgacatacgtgtgcgctatcaaagtggaaagatgctgttgtgctgtgtttgcagattggccagaatcatggtatatggatactaatggtatcaataagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacattattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacatttacatgtgatcagggatatcattctttggatccaaatgctgtctgcgaaacagataaatggaaatacgaaaatccatgcaagaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatattactgtatgtgtgggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcagtagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcggaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttttatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaaaaattcgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggcaaaattcttttcgttggtagatattgctctccaacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaacatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctattatatttctttctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgttaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccggaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcgatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctatccaactcattatagataacaaagaaaattccccgtataccatcgattgtttattgtatatacttagatatattgtagataagaatgtgataagatcgttggtggatcaacttccatctctacctatcttcaatataaaatcatttgagaaattcatatcctactgtatacttttagatgacacattttacaataggcacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaaca

SEQ ID NO: 58 - DNA, 17350 bp, Vaccinia virus
atgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagcgcaaagtgtcctcctattgaagacagtcttttatcgcacagatataaagactatgtggttaaatgggaaaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataaaaatagaaactataatcatataatagtgtaggttggtagtattgctcttgtgactagagactttagttaaggtactgtaaaaatagaaactataatcatataatagtgtaggttggtagtagggtactcgtgattaattttattgttaaacttgtccttaagtcttattaatatgtcttctaaagggggtagtggcggcatgtggagtgtctttatccatggacatgatggtagtaataaaggatctaaaacttatacatctggtggcggtggaatgtggggaggaggatcgtccagtggggttaacggaggtgtaaaatctggaactggtaaaatttaaacactaaattatttttattaataattgtacaagtttttgacatgatatttaatgacattagttgtgtgggtgtatagagttcacagtagctcattcagtcaaaatgtttgactatttggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattagaagaatacacaaatagtagacatgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatagaaaatggctgcagtgttctttatgaggacgagtactgatacgcgtatgatgattatcaactacgaaattgcggtaccgtattgcatctgtattcaaagtcggatacgagagcatatgtgcgtccggaagttgttaaatgtctaattaatcacggaatcaagccgtcttttatagataaaaactattgtacagctcttcaatattatattaagtcatctcatatagatatagacatcgttaaattgttaatgaaaggaatagataacactgcttattcatatatagacgatctaacatgttgcactcgaggaattatggctgattatctaaatagtgattatagatacaataaagatgtagatttggtcaaattgtttttggagaatggaaagcctcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacggatactttagaaatattaatattgattcttacacgatgaaatatctactaaaaaaggaagggagatgccatcaattatctcgatgatggagagatcccgattggacacctatgtaaatccaactatgaatgttataatttttacacttatacatacaaaaagggtctttgtgacatgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctaaaaacattgaactgctgaaaatgctattatgtcataaacctacattagattatgtgattgattcattgagagaaatatctaacatcgtagataactactatgctataaaacaatgtattaaatatgccatgattatagatgactgtacatcgtctaagattccagagtccataagtcaacgctataatgattatatagatctttgcaattaagaattgaatgagatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccaacgcaatagtgaaacatgatagaatacataaaaccatagaatcagttgatgataatacctacatttctaatcttccgtataccatcaaatacaaaatattcgagcaacaataagtattttttatacctttaaaattgataaataaattttttctagtgatattttggcaagatgagaatcctatttctcatcgccttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggataccaagtttatagaacatctgggtgatggcatcaaagaagatgaaaccgttcgtaccatagatggtagaatcgtcactctacagaaagtccttcatgtaaccgatactaataaatttgctcattataggttcacttgtgtcctcactacgatagatggcatttataaaaagaatgtttgctgaagtagttgtgtgctactatttttatttatgatataatctaaatgcaattgtcttgagaatccatccaatacggcagattatattagaaacaacgaattgaattgaatttaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatacatgttatgcaaaatatatgattacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtataggtattattagctatgtaccaatttaccaaccttcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtggatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaatcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaagacaattgccgttctagacatatccgtttcatataatagatcaataactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacagaaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgctgaaataaaaaatttttgtataatatctagaggtagaggtattgtttagataaatacaaataacatagatacatcgcatatttagcatttttataaatatacataagacatacactttatacatttttgtaaaaatactcataaaaaaaatttataaaaattatggcacaaccatatcttgtagaggtagtttagttcgtcgagtgaacctataaacagataatagacaacacataataataatgcctactaatacaagcataataccgggagatgggatatatgacgttgtagtgtttggtttttctgaacgttgatagtctactaatactacatgctgacatctaatgcctgtataaccatgagagcatctacaatacataccgtcgatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagatatttcatcgacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattacccttcattcttatattctttgcttacggaacctatatttagaaacatctactaacgattttttatgcttgcattattaatggtatgtaataccaatttgttaagtatgaatacggggtacaaacataaactgaaatttaacattatttatttatgatatatatcgttatcgttattgtttggtctataccatggatatctttaaagaactaatcgtaaaacaccctgatgaaaatgttttgatttctccagtttccattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccatgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtgattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtacctattctagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgacagtgatggtcacattccattacacaaatatttaactcatgatgaagttgagaatgatatgctttctgatagtatagatagctttagctaatataaaaatatattaatccactatatattctagacttgatttaaaaccgataaactactacgtactgtataagttgttaagaaaaggagcagaccctaattatgcagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaactgcagggcctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagtatacagtaagcatagatacgtcaaatctcaaattgtgcatctactgatatccagctattcgaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaagctagttgatttattacttagctaccatcccactctagagactatgattgacgcatttaatagagatatacgctatctatatcctgaaccattattcgcctgtatcagatacgccttaatcatagatgatgattttccttctaaagtaaagtatgatatcgccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacaaaagcaattattacaagtcaagtcacactaagatgcgagccgagaagcgattcatctacgcgataatagattatggagcaaacattaacgccgttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatattataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcgatggccaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagatgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacatcgtgtactcggacgaccactaccggtctcagcgaatccatctcaacgtcggaactaactattactatgaatcataaagactgcgatcccgtctttcgtgatggatacttctctgtccttaataaggtagcaacttcaggtttctttacaggagaaaggtgtgcactctgaatttcgagattaaatgcaataacaaagattcttcctccaaacagttaacgaaagcaaagaatgatactatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtaatcaatcaatagcaatcatgaaacaatatatcgtcctggcatgcatgtgcctgccagtcttcagcaatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagtattacaaaaatatttttatactctttctctctatgatggtctcataaaaaaagtattacaacaatatgattatgctcttactctctatgatggtctcataacataagtttacaacaatatgatgatctcatacctctgg

SEQ ID NO: 59 - DNA, 40 bp, Horsepox virus
tttattaaattttactatttatttagtgtctagaaaaaaa

SEQ ID NO: 60 - DNA, 1349 bp, Horsepox virus
tttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagttgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaagaaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatcggctcctggtacacatatacgttatttgagagatcatttctataatttaggaatgattatcaaatggatgctaattgacggacgccatcatgatcctattctaaatggattgcgtgatgtgactctagt

SEQ ID NO: 61 - DNA, 26 bp, Artificial Sequence
  Description of Artificial Sequence: Synthetic primer
cctattagatacatagatcctcgtcg

SEQ ID NO: 62 - DNA, 24 bp, Artificial Sequence
  Description of Artificial Sequence: Synthetic primer
cggtttatctaacgacacaacatc

What is claimed is:

1. A synthetic chimeric orthopoxvirus (scOPV), wherein the scOPV is replicated and reactivated from DNA derived from chemically synthesized DNA, wherein the wild type genome corresponding to said scOPV is selected from the group consisting of a horsepox virus, a vaccinia virus, a camelpox virus, a cowpox virus, an ectromelia virus, a monkeypox virus, a variola virus, a rabbitpox virus, a raccoonpox virus, a skunkpox virus, a taterapox virus, and a volepox virus, wherein the scOPV comprises a right terminal hairpin loop and a left terminal hairpin loop, one or both of the loops being heterologous to the corresponding wild type genome, and wherein the scOPV comprises one or more modifications to the corresponding wild type genome, the one or more modification being selected from the group consisting of modifications that eliminate one or more restriction sites and modifications that introduce one or more unique restriction sites.

2. The scOPV of claim 1, wherein the one or both of the terminal hairpin loops are derived from a vaccinia virus.

3. The scOPV of claim 2, wherein the terminal hairpin loops are independently selected from the group consisting of a slow form and a fast form of the vaccinia virus terminal hairpin loop.

4. The scOPV of claim 1, wherein the chemically synthesized DNA comprises overlapping chemically synthesized DNA fragments corresponding to substantially all of the corresponding wild type genome and wherein one or both of the terminal hairpin loops are derived from a vaccinia virus, a camelpox virus, a cowpox virus, an ectromelia virus, a monkeypox virus, a variola virus, a rabbitpox virus, a raccoon poxvirus, a skunkpox virus, a Taterapox virus, or a volepox virus.

5. The scOPV of claim 4, wherein the scOPV is replicated and reactivated from DNA derived from 1-14 overlapping chemically synthesized DNA fragments.

6. The scOPV of any one of claims 1, 2, 3, 4, or 5, wherein the scOPV is reactivated using leporipox virus-catalyzed recombination and reactivation.

7. A synthetic chimeric horsepox virus (scHPXV), wherein the scHPXV is replicated and reactivated from DNA derived from chemically synthesized DNA, wherein the genome of said scHPXV corresponds to a wild type genome of HPXV, wherein the scHPXV comprises a right terminal hairpin loop and a left terminal hairpin loop, one or both of the loops being heterologous to the corresponding wild type genome, wherein the scHPXV comprises one or more modifications to the corresponding wild type genome, the one or more modifications being selected from the group consisting of modifications that eliminate one or more restriction sites and modifications that introduce one or more unique restriction sites.

8. The scHPXV of claim 7, wherein the one or more modifications eliminate one or more of the AarI or BsaI restriction sites.

9. The scHPXV of claim 7, wherein one or both of the terminal hairpin loops are derived from a vaccinia virus, a camelpox virus, a cowpox virus, an ectromelia virus, a monkeypox virus, a variola virus, a rabbitpox virus, a raccoon poxvirus, a skunkpox virus, a Taterapox virus, or a volepox virus.

10. The scHPXV of claim 9, wherein the one or both terminal hairpin loops comprise left and right terminal hairpin loops derived from a vaccinia virus.

11. The scHPXV of claim 10, wherein the terminal hairpin loops are independently selected from the group consisting of a slow form and a fast form of the vaccinia virus terminal hairpin loop.

12. The scHPXV of claim 11, wherein the slow form comprises a nucleotide sequence that is at least 90% identical to the sequence of SEQ ID NO: 11 and the fast form comprises a nucleotide sequence that is at least 90% identical to the nucleotide sequence of SEQ ID NO: 12.

13. The scHPXV of claim 11, wherein the slow form consists of the nucleotide sequence of SEQ ID NO: 11 and the fast form consists of the nucleotide sequence of SEQ ID NO: 12.

14. The scHPXV of claim 7, wherein the chemically synthesized DNA comprises overlapping chemically synthesized DNA fragments that correspond to substantially all of the corresponding wild type HPXV genome and wherein the one or both terminal hairpin loops are derived from one or more of a vaccinia virus, a camelpox virus, a cowpox virus, an ectromelia virus, a monkeypox virus, a variola virus, a rabbitpox virus, a raccoon poxvirus, a skunkpox virus, a Taterapox virus, or a volepox virus.

15. The scHPXV of claim 14, wherein the scHPXV is replicated and reactivated from DNA derived from 1-14 overlapping chemically synthesized DNA fragments.

16. The scHPXV of claim 7 wherein the scHPXV is reactivated using leporipox virus-catalyzed recombination and reactivation.

17. A synthetic chimeric orthopox virus (scOPV) generated by a method comprising the steps of:
(i) chemically synthesizing overlapping DNA fragments that correspond to substantially all of a wild type genome is selected from the group consisting of a horsepox virus, a vaccinia virus, a camelpox virus, a cowpox virus, an ectromelia virus, a monkeypox virus, a variola virus, a rabbitpox virus, a raccoonpox virus, a skunkpox virus, a taterapox virus, and a volepox virus, wherein one or more of the overlapping DNA fragments are characterized by one or more modifications selected from the group consisting of modifications that eliminate one or more restriction sites and modifications that introduce one or more unique restriction sites,
(ii) chemically synthesizing terminal hairpin loops of a poxvirus and ligating the terminal hairpin loops to the overlapping DNA fragments derived from the chemically synthesized DNA that comprise the left and right termini of the viral genome,
wherein one or both the terminal hairpin loops are derived from one or more of a vaccinia virus, a camelpox virus, a cowpox virus, an ectromelia virus, a monkeypox virus, a variola virus, a rabbitpox virus, a raccoon poxvirus, a skunkpox virus, a Taterapox virus, or a volepox virus;
(iii) transfecting the overlapping DNA fragments derived from the overlapping chemically synthesized DNA fragments of steps (i) and (ii) into helper virus-infected cells;
(iv) culturing said cells to produce a mixture of helper virus and scOPV particles in said cells; and
(v) plating the mixture on OPV-specific host cells to recover the scOPV.

18. A synthetic chimeric horsepox virus (scHPXV) generated by a method comprising the steps of:
(i) chemically synthesizing overlapping DNA fragments that correspond to substantially all of a wild type HPXV genome, wherein one of more of the overlapping DNA fragments are characterized by one or more modifications selected from the group consisting of modifications that eliminate one or more restriction sites and modifications that introduce one or more unique restriction sites;
(ii) chemically synthesizing terminal hairpin loops of a poxvirus and ligating the terminal hairpin loops to the overlapping DNA fragments derived from the chemically synthesized DNA that comprise the left and right termini of the viral genome, wherein one or both of the terminal hairpin loops are derived from one or more of a vaccinia virus, a camelpox virus, a cowpox virus, an ectromelia virus, a monkeypox virus, a variola virus, a rabbitpox virus, a raccoon poxvirus, a skunkpox virus, a Taterapox virus, or a volepox virus;

(iii) transfecting the overlapping DNA fragments derived from the overlapping chemically synthesized DNA fragments of steps (i) and (ii) into helper virus-infected cells;
(iv) culturing said cells to produce a mixture of helper virus and scHPXV particles in said cells; and
(v) plating the mixture on HPXV-specific host cells to recover the scHPXV.

19. A composition comprising the scOPV of claim 1 or 17 and a pharmaceutically acceptable carrier.

20. A composition comprising the scHPXV of claim 7 or 18 and a pharmaceutically acceptable carrier.

* * * * *

UNITED STATES PATENT AND TRADEMARK OFFICE
CERTIFICATE OF CORRECTION

PATENT NO. : 11,345,896 B2  
APPLICATION NO. : 15/802189  
DATED : May 31, 2022  
INVENTOR(S) : David Evans et al.

Page 1 of 1

It is certified that error appears in the above-identified patent and that said Letters Patent is hereby corrected as shown below:

In the Claims

In Claim 8, Column 57, Line 41, change "scHIPXV" to --scHPXV--

In Claim 9, Column 57, Line 44, change "scHIPXV" to --scHPXV--

In Claim 16, Column 58, Line 11, change "claim 7" to --claim 7,--

Signed and Sealed this  
Twenty-sixth Day of July, 2022

Katherine Kelly Vidal  
*Director of the United States Patent and Trademark Office*